US007705201B2

(12) United States Patent
He

(10) Patent No.: US 7,705,201 B2
(45) Date of Patent: Apr. 27, 2010

(54) TRANSGENIC PLANTS EXPRESSING CYTOKININ BIOSYNTHETIC GENES AND METHODS OF USE THEREFOR

(75) Inventor: Steve S. He, St. Louis, MO (US)

(73) Assignee: Monsanto Technology LLC, St. Louis, MO (US)

( * ) Notice: Subject to any disclaimer, the term of this patent is extended or adjusted under 35 U.S.C. 154(b) by 953 days.

(21) Appl. No.: 11/156,084

(22) Filed: Jun. 17, 2005

(65) Prior Publication Data

US 2006/0010515 A1 Jan. 12, 2006

Related U.S. Application Data

(60) Provisional application No. 60/582,357, filed on Jun. 23, 2004.

(51) Int. Cl.
*C12N 15/82* (2006.01)
*A01H 5/00* (2006.01)
*A01H 5/10* (2006.01)

(52) U.S. Cl. ............... 800/287; 800/298; 800/290; 435/320.1; 435/419

(58) Field of Classification Search ............... None
See application file for complete search history.

(56) References Cited

U.S. PATENT DOCUMENTS

| 5,322,938 | A | 6/1994 | McPherson et al. | 536/24.1 |
|---|---|---|---|---|
| 5,641,876 | A | 6/1997 | McElroy et al. | 536/24.1 |
| 5,858,742 | A | 1/1999 | Fraley et al. | 435/172.3 |
| 6,248,876 | B1 | 6/2001 | Barry et al. | 536/24.3 |
| 2002/0042934 | A1* | 4/2002 | Staub et al. | 800/300 |

OTHER PUBLICATIONS

Brooks, et al. (1996) Functional Analysis of the Human Cyclin D2 and Cyclin D3 Promoters vol. 271, No. 15, Issue of Apr. 12, 1996 pp. 9090-9099.*
Ma, et al. (2002) Functional Plant Biol. 29:1107-1113.*
Ma Q.H. et al. Increased seed cytokinin levels in transgenic tobacco influence embryo and seeding development. 2002. Funct. Plant Biol. 29:1107-1113.*
Werner T. et al. Regulation of plant growth by cytokinin. Proc Natl Acad Sci U S A. Aug. 28, 2001;98(18):10487-92. Epub Aug. 14, 2001.*
Shaul O. et al. Two *Arabidopsis* cyclin promoters mediate distinctive transcriptional oscillation in synchronized tobacco BY-2 cells. Proc Natl Acad Sci U S A. May 14, 1996;93(10):4868-72.*
An et al., "Functional analysis of the 3' control region of the potato wound-inducible proteinase inhibitor II gene," *Plant Cell*,1(1):115-122, 1989.
Barker et al., "Nucleotide sequence of the T-DNA region from the *Agrobacterium tumefaciens* octopine Ti plasmid pTi15955," *Plant Mol. Biol.*, 2:335-350, 1983.
Depicker et al., "Nopaline synthase: transcript mapping and DNA sequence," *J. Mol. Appl. Genet.*, 1:561-573, 1982.

Faiss et al., "Conditional transgenic expression of the ipt gene indicates a function for cytokinins in paracrine signaling in whole tobacco plants," *The Plant Journal*, 12(2):401-415, 1997.
Gateway™ Cloning Technology Instruction Manual, Version 1, Undated.
GenBank Accession No. AL035601, Nov. 14, 2006.
GenBank Accession No. AL132963, Nov. 14, 2006.
GenBank Accession No. AL161585, Nov. 14, 2006.
GenBank Accession No. U30508, Jun. 27, 1996.
Hewelt et al., "Promoter tagging with a promoterless ipt gene leads to cytokinin-induced phenotypic variability in transgenic tobacco plants: implications of gene dosage effects," *Plant J.*, 6(6):879-891, 1994.
Hlinkova et al., "Phenotypes of tobacco plants expressing genes for the synthesis of growth regulators," *Biologia Plantarum*, 41:25-37, 1998.
Klee et al., "*Agrobacterium*-mediated plant transformation and its further applications to plant biology," *Ann. Rev. Plant Physiol.*, 38:467-486, 1987.
Klee et al., "Cloning of *Arabidopsis thaliana* gene encoding 5-enolpyruvylshikimate-3-phosphate synthase: sequence analysis and manipulation to obtain glyphosate-tolerant plants," *Mol. Gen. Genet.*, 210:437-442, 1987.
Li et al., "Altered morphology in transgenic tobacco plants that overproduce cytokinins in specific tissues and organs," *Dev. Biol.*, 153:386-395, 1992.
McDowell et al., "The *Arabidopsis* ACT7 actin gene is expressed in rapidly developing tissues and responds to several external stimuli," *Plant Physiol.*, 111:699-711, 1996.
Medford et al., "Alterations of endogenous cytokinins in transgenic plants using a chimeric isopentenyl transferase gene," *The Plant Cell*, 1:403-413, 1989.
Meijer et al., "Cell cycle controls and development of plant form," *Curr. Opin. Plant Biol.*, 4(1):44-49, 2001.
Renaudin et al., "Plant cyclins: a unified nomenclature for plant A-, B- and D-type cyclins based on sequence organization," *Plant Mol. Biol.*, 32(6):1003-1018, 1996.
Roeckel et al., "Effects of seed-specific expression of a cytokinin biosynthetic gene on canola and tobacco phenotypes," *Transgenic Res.*, 6(2):133-141, 1997.
Schmulling et al., "Construction of a heat inducible chimeric gene to increase the cytokinin content in transgenic plant tissue," *FEBS Letters*, 249:401-406, 1989.
Smart et al., "Delayed leaf senescence in tobacco plants transformed with tmr, a gene for cytokinin production in *Agrobacterium*," *The Plant Cell*, 3:647-656, 1991.
Smigocki et al., "Cytokinin gene fused with a strong promoter enhances shoot organogenesis and zeatin levels in transformed plant cells," *Proc. Natl. Acad. Sci. USA*, 85:5131-5135, 1991.
Soni et al., "A family of cyclin D homologs from plants differentially controlled by growth regulators and containing the conserved retinoblastoma protein interaction motif," *The Plant Cell*, 7:85-103, 1995.
Stals et al., "Regulation of cyclin-dependent kinases in *Arabidopsis thaliana*," *Plant Mol. Biol.*, 43:583-593, 2000.

(Continued)

*Primary Examiner*—Cynthia Collins
(74) *Attorney, Agent, or Firm*—Brin C. Robert, Esq.; Sonnenschein Nath & Rosenthal LLP

(57) ABSTRACT

The present invention provides an approach to increase yield and vigor in a plant. The present invention describes expressing a heterologous gene in a plant that control cytokinin expression under the control of a cell cycle regulated promoter.

6 Claims, 8 Drawing Sheets

OTHER PUBLICATIONS

Van Loven et al., "Morphometric analysis of the growth of Phsp70-ipt transgenic tobacco plants," *J. Exp. Bot.*, 44:1671-1678, 1993.

Atanassova et al., "A 126 bp fragment of a plant histone gene promoter confers preferential expression in meristems of transgenic *Arabidopsis*," *The Plant J.*, 2(3):291-300, 1992.

Aubert et al., "Expression patterns of GASA genes in *Arabidopsis thaliana*: the GASA4 gene is up-regulated by gibberellins in meristematic regions," *Plant Mol. Biol.*, 36:871-883, 1998.

Ito et al., "A novel cis-acting element in promoters of plant B-type cyclin genes activates M phase-specific transcription," *The Plant Cell*, 10:331-341, 1998.

Kosugi et al., "Two of three promoter elements identified in a rice gene for proliferating cell nuclear antigen are essential for meristematic tissue-specific expression," *The Plant J.*, 7(6):877-886, 1995.

Sykorova et al., "Senescence-induced ectopic expression of the *A. tunefaciens* ipt gene in wheat delays leaf senescence, increases cytokinin content, nitrate influx, and nitrate reducatse activity, but does not affect grain yield," *J. of Exper. Bot.*, 59(2):377-387, 2008.

Tremousaygue et al., "Internal telomeric repeats and 'TCP domain' protein-binding sites co-operate to regulate gene expression in *Arabidopsis thaliana* cycling cells," *The Plant J.*, 33:957-966, 2003.

\* cited by examiner

TRANSGENIC PLANTS EXPRESSING CYTOKININ BIOSYNTHETIC GENES AND METHODS OF USE THEREFOR

CROSS REFERENCE TO RELATED APPLICATIONS

This application claims benefit under 35USC § 119(e) of U.S. provisional application Ser. No. 60/582,357 filed Jun. 23, 2004.

INCORPORATION OF SEQUENCE LISTING

Two copies of the sequence listing (Copy 1 and Copy 2) and a computer readable form (CRF) of the sequence listing, all on CD-ROMs, each containing the file named SEQUENCE_LISTING.txt, which is approximately 901,120 Bytes (measured in MS-WINDOWS), are herein incorporated by reference.

FIELD OF THE INVENTION

The invention relates generally to plant molecular biology and more particularly to the expression of isopentenyl transferase genes in plants under the control of cell cycle promoters that function in plants.

BACKGROUND OF THE INVENTION

One of the goals of plant genetic engineering is to produce plants with agronomically important characteristics or traits. Recent advances in genetic engineering have provided the requisite tools to transform plants to contain and express foreign genes. Particularly desirable traits or qualities of interest for plant genetic engineering include but are not limited to resistance to insects and other pests and disease-causing agents, tolerances to herbicides, enhanced stability, yield, yield stability, shelf-life, environmental tolerances, and nutritional enhancements. The technological advances in plant transformation and regeneration have enabled researchers to take pieces of DNA, such as a gene or genes from a heterologous source, or a native source, and incorporate the exogenous DNA into the plant's genome. The gene or gene(s) can then be expressed in the plant cell to exhibit the added characteristic(s) or trait(s). In one approach, expression of a novel gene that is not normally expressed in a particular plant or plant tissue confers a desired phenotypic effect(s).

Plant growth and development is controlled by a diverse array of phytohormones in response to endogenous signals and environmental cues. These molecules include auxins, gibberellins, ethylene, cytokinins, abscisic acid, brassinosteroids, oligosaccharides, jasmonates, salicylic acid, and polyamines. In recent years, the large-scale sequencing of plant genomes, together with extensive molecular, genetic and biochemical studies, has led to the elucidation of the biosynthetic pathways for cytokinin biosynthesis. This in turn has allowed for new approaches to crop improvement by manipulating the expression of genes regulating the plant hormone biosynthesis through novel combination of gene expression elements and structural genes. Prior work has shown through both forward and reverse genetic analyses that plant hormonal regulation is highly complex. This has made it difficult to develop transgenic plants with improved agronomic traits but without deleterious pleiotropic effects.

Isopentenyl transferase (IPT) is a gene that was first isolated from *Agrobacterium tumefaciens* T-DNA. It was shown that expression of IPT in transgenic plants resulted in elevated cytokinin accumulation, which was accompanied by morphological alterations of transgenic plants Expression of IPT in an entire plant has phenotypes that are not advantageous, causing dwarfing, reduced leaf area, and thicker stems (Hlinkova, E., et al., *Biologia Plantarum*, Vol.41: 25-37, 1998). Expression in entire plants also leads to stunting, loss of apical dominance, reduction in root initiation and growth, either acceleration or prolonged delayed senescence in leaves (depending on growth conditions), adventitious shoot formation from unwounded leaf veins and petioles, altered nutrient distribution, and abnormal tissue development in stems (Li, et al., *Dev Biol* 153: 386-395, 1992). When IPT is constitutively expressed at high level through either the CaMV 35S promoter or the native IPT promoter, the transgenic plants would develop severely retarded shooty morphology and would fail to root (Klee et al., *Ann Rev Plant Phys* 38:467-486, 1987). Whole plants transformed with IPT genes with weaker or controlled expression, such as the promoter of heat shock protein genes, also display the effects of cytokinin overproduction, such as uncontrolled axillary bud growth as a result of the loss of apical dominance, the development of small, rounded or curling leaves, and the retardation of root formation (Medford et al., *Plant Cell* 1:403-413, 1989; Schmulling et al., *FEBS Letters* 249:401-406, 1989; Smigocki, *PNAS* 85: 5131-5135, 1991; Hewelt et al., *Plant J* 6: 879-891, 1994; Smart et al., *Plant Cell* 647-656, 1991; Van Loven et al., *J Exp Bot* 44: 1671-1678, 1993; Faiss et al., *Plant J* 12: 401-425, 1997). It was also shown that low level of constitutive IPT expression, such as that directed by a heat shock promoter under non-inductive conditions, would be sufficient to induce abnormal plant growth and development (Medford et al., *Plant Cell* 1:403-413 1989; Smigocki, *PNAS* 85: 5131-5135, 1991). Remarkably, such deleterious pleiotrophs occurred even when some seemingly tissue or organ specific promoters were used to drive the IPT expression in plants. For example, when an auxin-inducible bidirectional promoter from the soybean SAUR gene was used to drive the expression of IPT in transgenic tobacco plants, the transgene-produced cytokinin was present in a tissue-and organ-specific manner. Yet the localized overproduction of cytokinins still resulted in a number of morphological and physiological off-types, including stunting, loss of apical dominance, reduction in root initiation and growth, abnormal leaf development, adventitious shoot formation from unwounded leaf veins and petioles, altered nutrient distribution, and abnormal tissue development in stems (Li, et al., *Dev Biol* 153: 386-395, 1992). When IPT was specifically expressed in developing seeds using a highly specific seed promoter, no seed size increase was observed (Roeckel et al., *Transgenic Res* 6:133-141, 1997). We show that, despite these and other teachings against expression of IPT in plants, the expression under certain cell cycle regulated promoters leads to advantageous phenotypes.

SUMMARY OF THE INVENTION

In accordance with the present invention, it has been found that a transgenic plant expressing a cytokinin biosynthetic protein under the regulatory control of a cell cycle regulated promoter exhibits improved yield related characteristics manifested in desirable phenotypes under field growing conditions. By this invention, therefore, compositions and methods of use related to DNA polynucleotides comprising a cell cycle regulated promoter operably linked to a polynucleotide encoding a cytokinin biosynthetic protein, e.g. an isopentenyl transferase, are provided. Also provided herein are transgenic plants and plant cells expressing a desired cytokinin biosynthetic protein under control of a cell cycle regulated promoter whose expression of an operably linked polynucleotide is highest in dividing cells as compared to non-dividing cells and methods of use related to such transgenic plants.

In accordance with one aspect of the invention transgenic plants expressing a cytokinin biosynthetic protein under the control of a cell cycle regulated promoter are provided wherein the plants exhibit at least one phenotypic trait selected from the group consisting of accelerated plant growth, increased organ size, increased organ number, increased reproductive organ number, increased seed size, increased silique number, and/or increased seed number when compared to a plant of the same species not expressing such cytokinin biosynthetic protein under the control of a cell cycle regulated promoter.

In accordance with a further aspect of the invention, recombinant DNA polynucleotides comprising a cell cycle regulated promoter that functions in plants operably linked to a DNA polynucleotide which encodes a protein involved in cytokinin biosynthesis are provided.

In accordance with another aspect of the invention, cell cycle regulated promoters are provided. More particularly, such promoters are identified from the 5' upstream region of the family of cyclin genes, such as the promoter regions selected from the group consisting of the CycD3 and CycB1 genes.

Also provided are recombinant DNA polynucleotides encoding a protein that are similar to an isopentenyl transferase, encodes a protein that is substantially identical to, or hybridizes to a nucleic acid encoding, a protein selected from the group consisting of SEQ ID NO: 1, 2, 15, 17, 19, 21 and 22-359.

Also provided are recombinant DNA molecules with combinations of cyclin promoters and DNA polynucleotides encoding an isopentyl transferase and transgenic plants containing such a recombinant DNA molecule.

BRIEF DESCRIPTION OF THE DRAWING FIGURES

Figure 4:
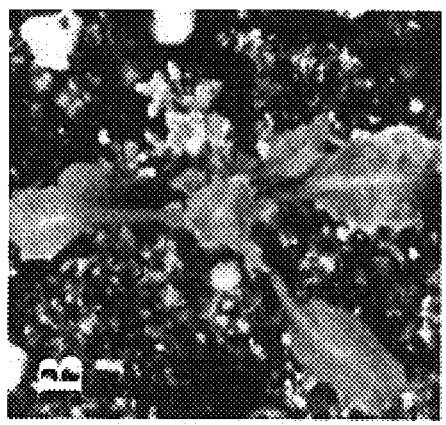
Figure 4:
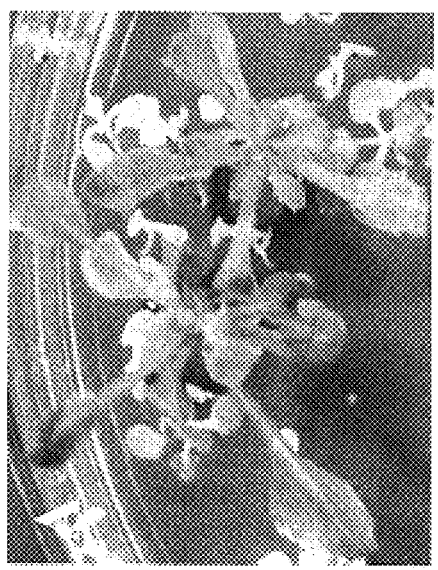

FIG. 4 is a visual representation of the problems of expression of IPT in non-dividing cells. Panels A (left) illustrates the observed phenotype of a plant when a largely constitutive promoter is used (E35S) in accordance with the constructs of the present invention. Panel B (right) shows the observed phenotype when a less constitutive promoter is used, but one that allows expression in non-dividing cells (AtCDC2a).

Figure 5:
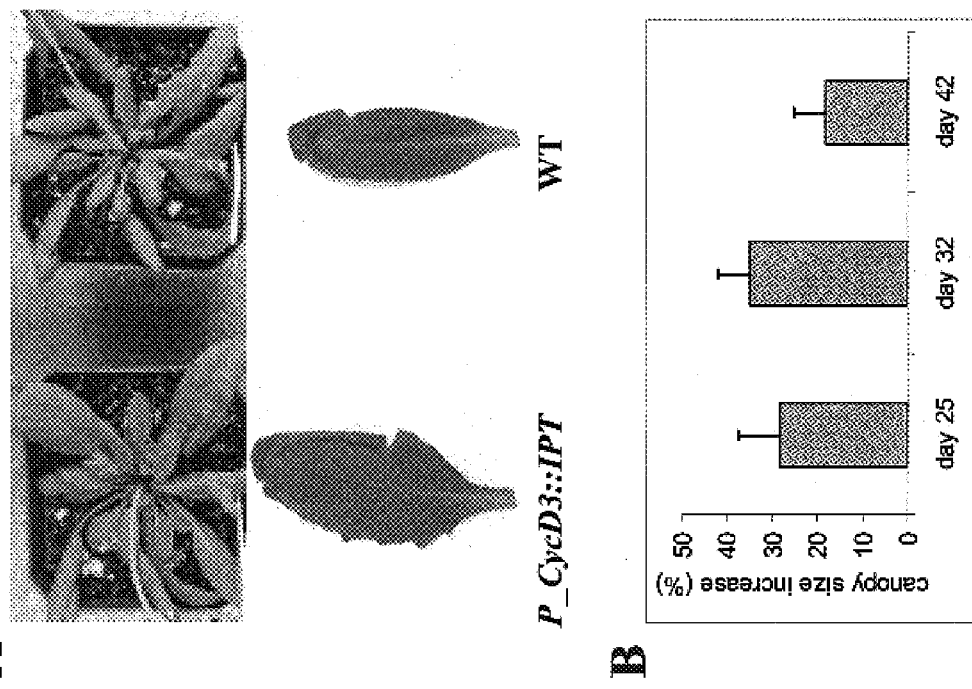

FIG. 5 shows the increased canopy size of plants transformed with CycD3::IPT compared to wild type.

Figure 6:
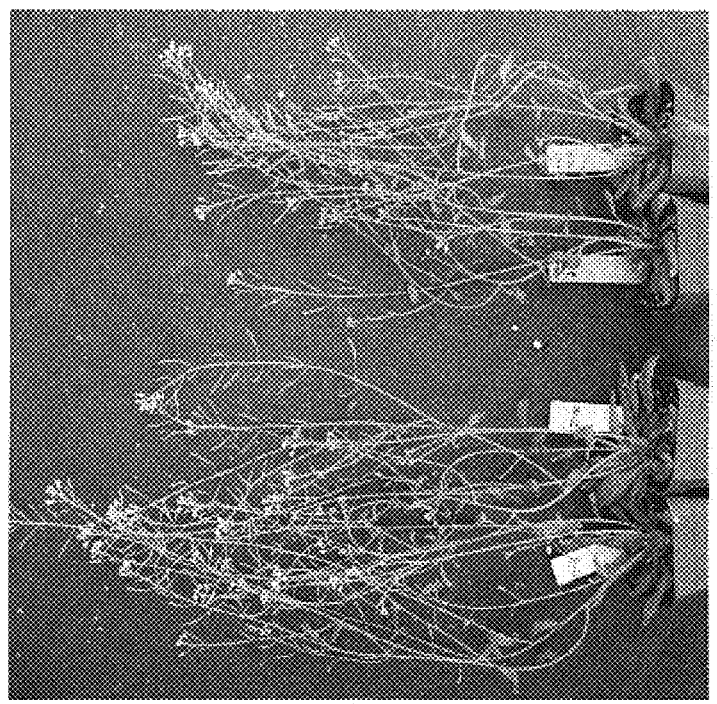

FIG. 6 shows the mature plant size of plants transformed with CycD3::IPT compared to wild type.

Figure 7:
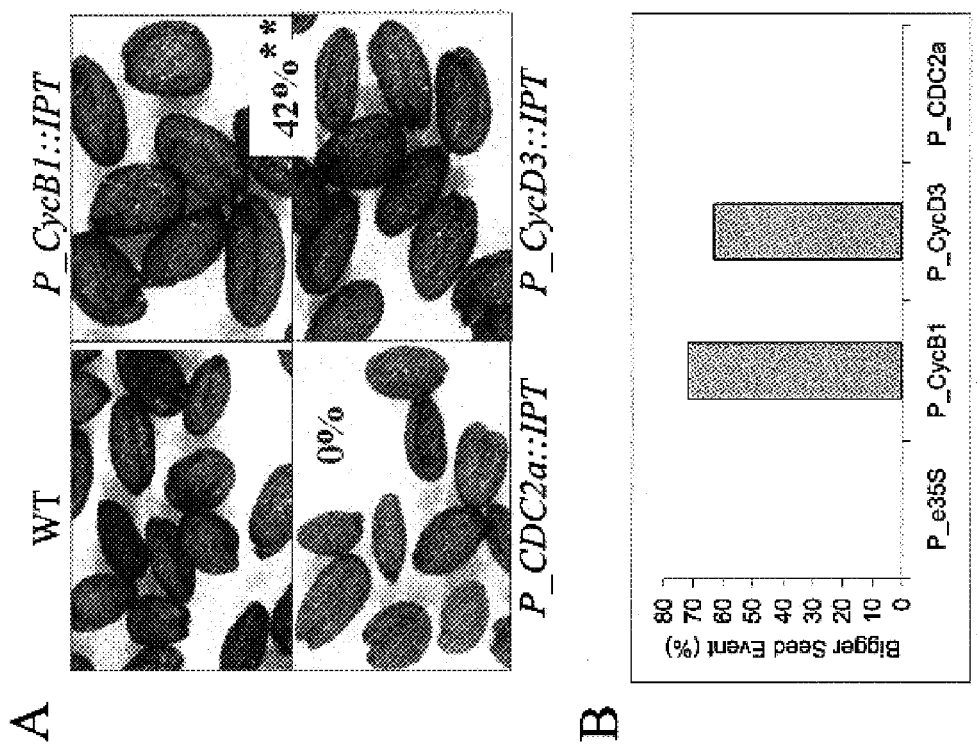

FIG. 7 shows the relative seed size of plants transformed with different promoters driving IPT.

Figure 8:
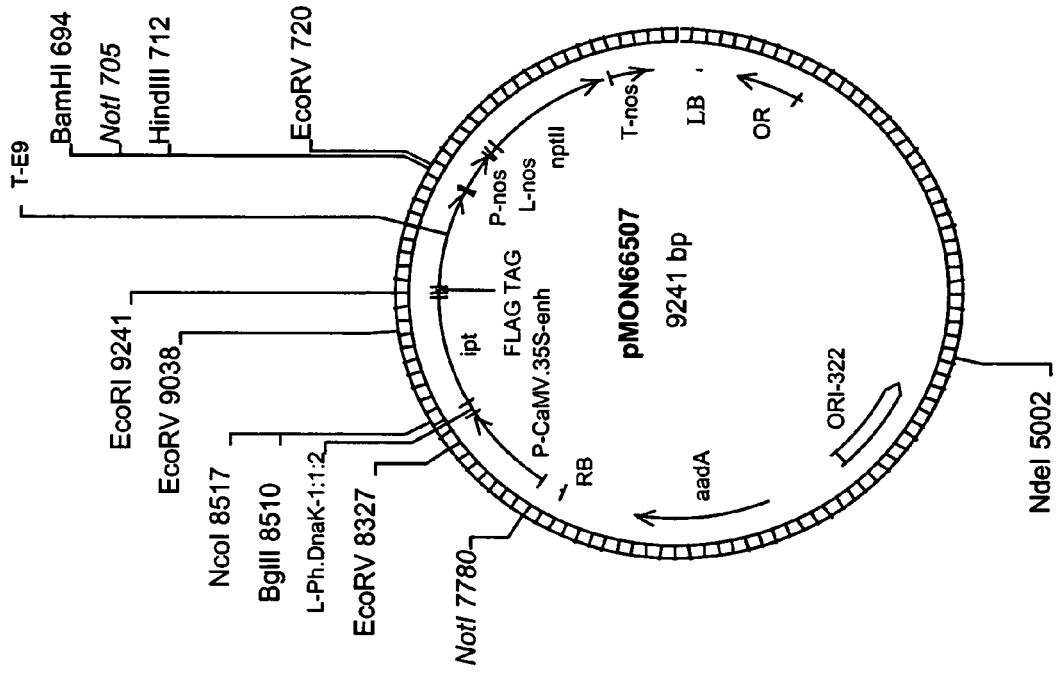

FIG. 8 shows a map of plasmid pMON66507. This plasmid was the base vector for many plasmids used herein and contains the portions required for propagation in bacteria and Agrobacterium-mediated transformation in plants. The E35S promoter was removed and a number of different cyclin promoters and CDC2a promoter were added to this vector to create many of the vectors created herein, see examples.

DETAILED DESCRIPTION OF THE INVENTION

It has been discovered that a transgenic plant expressing a cytokinin biosynthetic protein under the regulatory control of a cell cycle regulated promoter exhibits improved yield related characteristics manifested in desirable phenotypes under field growing conditions. By this invention, therefore, compositions and methods of use related to DNA polynucleotides comprising a cell cycle regulated promoter operably linked to a polynucleotide encoding a cytokinin biosynthetic protein, e.g. an isopentenyl transferase, are provided. Also provided herein are transgenic plants and plant cells expressing a desired cytokinin biosynthetic protein under control of a cell cycle regulated promoter whose expression of an operably linked polynucleotide is highest in dividing cells as compared to non-dividing cells and methods of use related to such transgenic plants.

Isopentyl transferase(IPT) is a gene involved in cytokinin biosynthesis that may be isolated from many species. One particular IPT is a gene isolated from *Agrobacterium tumefaciens* T-DNA. It has been shown that expression of IPT in transgenic plants resulted in elevated cytokinin accumulation, which was accompanied by morphological alterations of transgenic plants. Constitutive expression of IPT in an entire plant exhibits phenotypes that are not advantageous for a growing crop. Herein it is shown that the expression of IPT under the regulatory control of a cell cycle regulated promoter whose expression is predominantly in dividing cells of the plant provides advantageous phenotypes directed to yield that are useful for a growing crop plant.

"Isopentyl transferase" or "isopentenyl transferase" or "IPT" or "ipt " as used herein includes any enzyme that catalyzes the reaction of adenosine 5'-monphosphate or adenosine 5;-triphosphate and dimethylallyl disphosphate to $N^6$-($\Delta^2$-isopentenyl)adenosine 5'-phosphate, including but not limited to all isopentenyl transferase/dimethylallyl transferase from all sources including plants, animals, and microbes (Buchanan, et al., Biochemistry and Molecular Biology of Plants, Courier Companies, Inc., USA, ISBN 0-943088-39-9; Haberer and Kieber, *Plant Physiology* 128: 354 (2002)). "Isopentyl transferase" or "isopenteny transferase" or "IPT" or "ipt" also includes any enzyme that increases cytokinin levels through a pathway which includes zeatinriboside-5'-monophosphate (ZMP) (Astot, et al., *PNAS* 97:14778-14883, 2000). Examples of IPT and IPT-like proteins that are within the scope of the invention include SEQ ID NOs: 2, 15, 17, 19, 21, and 22-359, and any protein related thereto, or any nucleotide sequence encoding such a protein including such nucleotide sequences that would hybridize to any of SEQ ID Nos: 1, 14, 16, 18 and 20 under stringent conditions as described hereinafter. IPT genes expected to function in the invention include, but are not limited to, for example, proteins which contain the motif found in many IPT genes, such as PF01715 are also expected to function in the invention. These latter motifs are from Pfam which describes IPT and IPPT as follows: IPT or isopentenyl transferase/ dimethylallyl transferase synthesizes isopentenyladensosine 5'-monophosphate, a cytokinin that induces shoot formation on host plants infected with the Ti plasmid. IPPT is a family of IPP transferases (EC:2.5.1.8) also known as tRNA delta (2)-isopentenylpyrophosphate transferase, these enzymes modify both cytoplasmic and mitochondrial tRNAs at A(37) to give isopentenyl A(37). Pfam is a large collection of multiple sequence alignments and hidden Markov models covering many common protein families. Pfam version 12.0 (January 2004) contains alignments and models for 7316 protein families, based on the Swissprot 42.5 and SP-TrEMBL 25.6 protein sequence databases.

"Promoter," as used herein, refers to a DNA polynucleotide that binds an RNA polymerase (either directly or indirectly through another transcription factors) and promotes transcription of a downstream DNA polynucleotide. The downstream DNA polynucleotide can be transcribed into an RNA that has function, such as rRNA, RNAi, dsRNA, or tRNA. Often, the RNA produced is a hetero-nuclear (hn) RNA that has introns which are spliced out to produce an mRNA (messenger RNA). A "plant promoter" is a native or non-native promoter that is functional in plant cells A cell cycle regulated promoter is a promoter that is regulated in its expression during the cell cycle. Cell cycle regulated promoters, as used herein, are further characterized in that they express an operably linked polynucleotide at their highest levels in actively dividing cells as compared to non-dividing cells. Preferably, cell cycle regulated promoters of the present invention are characterized by a reduction of about 20%-about 30% in the expression level of an operably linked polynucleotide in non-dividing cells. More preferably, a cell cycle regulated promoter of the present invention has an expression pattern wherein 10% or less of the expression of an operably linked polynucleotide can be attributed to non-dividing cells. The promoters herein encompass not only the sequences of the cell cycle regulated promoters described herein, but sequences that hybridize (as defined hereinafter) to at least one of the cell cycle regulated promoter sequences provided herein and operative fragments thereof, that function as plant promoters in the same or similar manner. In particularly preferred embodiments, the cell cycle regulated promoter is a promoter isolated from a member of the cyclin gene family. Specific cyclin promoters include those selected from the group consisting of the promoters identified herein as CycD3 (SEQ ID NO:8) or CycB1 (SEQ ID NO:5), both *Arabidopsis* promoters. The term "cyclin" refers to a regulatory protein, comprising a protein domain of about 100 amino acids known as the "cyclin box". The cyclin box is the binding site for cyclin-dependent kinases, allowing the cyclin to exert its regulatory effect on the kinase activity of the CDKs. A cyclin box can be identified by comparing the amino acid sequence of the protein with known cyclin boxes. An amino acid sequence identified as a cyclin box on the basis of sequence comparison should possess at least the 5 conserved residues required for cyclin activity R(97), D(126), L(144), K(155), and E(185) (indicated positions are from the sequence of CYCD2 from *Arabidopsis thaliana*) at equivalent positions. (See, e.g., Soni et al., *Plant Cell*, 7:85-103 (1995) and Renaudin et al., *Plant Molecular Biology*, 32:1003-1018 (1996)) (R=arginine, D=aspartic acid, L=leucine, K=lysine, and E=glutamic acid).Cyclin promoters are those promoters that drive the expression of cyclin genes at specific times within each cell cycle in the organism in which they occur, for example, plants. Specific cyclin promoters include those of specific cyclin genes, for example see the sequence listing and examples. Cell cycle progression requires the activation of cyclin-dependent kinases (CDKs) whose catalytic activity and substrate specificity are determined by cyclins and by other regulatory proteins (Hilde et al., *Plant Molecular Biology*, 43:583-593, 2000; Marcel and Murray, *Current Opinion in Plant Biology*, 4:44-49, 2002). The activity of the CDK-cyclin complexes is activated and deactivated at specific points in the cell cycle. Certain CDK-cyclin complexes are activated at the G1-S transition and trigger the start of DNA replication. Different CDK-cyclin complexes are activated at the G2/M transition and induce mitosis leading to cell division. As used herein, cell division control (CDC) genes are genes that control cell division, and are differently expressed during cell division. Promoters isolated from a CDC genes of specific types, for example, CDC2a (SEQ ID NO: 11) do not have expression patterns that provide high level expression predominantly in dividing cells.

A first nucleic acid or protein sequence displays "substantial identity" or "substantial similarity" to a reference nucleic acid sequence or protein if, when optimally aligned (with appropriate nucleotide or amino acid insertions or deletions totaling less than 20 percent of the reference sequence over the window of comparison) with the other nucleic acid (or its complementary strand) or protein, there is at least about 60% nucleotide sequence equivalence, even better would be 70%, preferably at least about 80% equivalence, more preferably at least about 85% equivalence, and most preferably at least about 90% equivalence over a comparison window of at least 20 nucleotide or amino acid positions, preferably at least 50 nucleotide or amino acid positions, more preferably at least 100 nucleotide or amino acid positions, and most preferably over the entire length of the first nucleic acid or protein. Optimal alignment of sequences for aligning a comparison window may be conducted by the local homology algorithm(s), preferably by computerized implementations of these algorithms (which can be found in, for example, Wisconsin Genetics Software Package Release 7.0, Genetics Computer Group, 575 Science Dr., Madison, Wis.). The reference nucleic acid may be a full-length molecule or a portion of a longer molecule. Alternatively, two nucleic acids have substantial identity if one hybridizes to the other under stringent conditions. Appropriate hybridization conditions can be determined empirically, or can be estimated based, for example, on the relative G+C content of the probe and the number of mismatches between the probe and target sequence, if known. Hybridization conditions can be adjusted as desired by varying, for example, the temperature of hybridizing or the salt concentration (Sambrook et al., *Molecular Cloning. A Laboratory Manual, 2nd Edition*, Cold Spring Harbor Press, 1989).

The term "recombinant DNAs" or "recombinant DNA molecules" as used herein means DNAs that contains a genetically engineered modification through manipulation via mutagenesis, restriction enzymes, and the like. The polynucleotide itself can come from either naturally occurring sources or can be created in the laboratory. It can also include all vectors created by DNA engineering, for example, all the DNA molecules included herein designated by pMON. For example, it can include molecules containing naturally occurring DNA or cDNA, or DNA molecules of synthetic origin in a plasmid, or isolated DNA. A "recombinant" polynucleotide or "recombinant DNA molecule" can be made by an artificial combination of two otherwise separated segments of a polynucleotide, e.g., by chemical synthesis or by the manipulation of isolated segments of polynucleotides by genetic engineering techniques. Techniques for nucleic-acid manipulation are well-known (see, e.g., Sambrook et al., Molecular Cloning, A Laboratory Manual, Cold Spring Harbor Press, Plainview, N.Y. (1989); and Ausubel et al., Current Protocols in Molecular Biology, John Wiley & Sons, New York, N.Y. (1988). The terms "recombinant DNA construct", "recombinant vector", "expression vector" or "expression cassette" refer to any agent such as a plasmid, cosmid, virus, BAC (bacterial artificial chromosome), autonomously replicating polynucleotide, phage, or linear or circular single-stranded or double-stranded DNA or RNA polynucleotide, derived from any source, capable of genomic integration or autonomous replication, comprising a DNA molecule in which one or more DNA polynucleotides have been linked in a functionally operative manner.

Hybridization conditions are dependent on the sequence of the polynucelotide and will be different in different circumstances. As used herein "stringent conditions" are selected to be about 5° C. lower than the thermal melting point (Tm) for the specific polynucleotide at a defined ionic strength and pH. The "thermal melting point" is the temperature (under defined ionic strength and pH) at which 50% of a target molecule hybridizes to a completely complementary molecule. Appropriate stringent conditions which promote DNA hybridization, for example, 6.0× sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1-6.3.6, incorporated herein by reference in its entirety. For example, the salt concentration in the wash step can be selected from a low stringent condition of about 2.0×SSC at 50° C. to a high stringency of about 0.2×SSC at 50° C. In addition, the temperature in the wash step can be increased from low stringent conditions at room temperature, about 22° C., to high stringent conditions at about 65° C. Both temperature and salt concentration may be varied, or either the temperature or the salt concentration may be held constant while the other variable is changed. For the purposes of this disclosure, stringent conditions include at least one wash in 2.0×SSC at a temperature of at least about 50° C. for 20 minutes, or equivalent conditions.

A first polynucleotide is "operably linked" with a second polynucleotide when the polynucleotides are so arranged that the first polynucleotide affects the function of the second polynucleotide. Often, the two polynucleotides are part of a single contiguous polynucleotide molecule and sometimes are adjacent. For example, a promoter is operably linked to a gene if the promoter regulates or mediates transcription of the gene. A promoter is "naturally operably linked" to a structural gene if the promoter drives the transcription of the structural gene in the genome of an organism when said promoter and said structural gene are in their native locations within said genome.

"Heterologous" sequence refers to a sequence which originates from a foreign source or species or, if from the same source or species, is modified from its original form; for example, a gene from a fungus being expressed in a plant; or a gene from the same species present under a different promoter, or a promoter driving the expression of a gene or RNA in a non-native location within the genome.

An "isolated" nucleic acid sequence or DNA molecule is substantially separated or purified away from other nucleic acid sequences with which the nucleic acid is normally associated in the cell of the organism in which the nucleic acid naturally occurs, i.e., other chromosomal or extrachromosomal DNA. The term embraces nucleic acids that are biochemically purified so as to substantially remove contaminating nucleic acids and other cellular components. The term also embraces recombinant nucleic acids and chemically synthesized nucleic acids.

"Native" refers to a naturally occurring ("wild-type") nucleic acid sequence.

In a preferred embodiment, the instant invention comprises a transgenic plant comprising a recombinant DNA molecule having a cell cycle regulated promoter operably linked to a cytokinin biosynthetic enzyme. The plant may be a monocotyledonous plant or dicotyledonous, and includes but is not limited to corn, soybean, *Arabidopsis*, cotton, wheat, rice, and canola.

Recombinant DNA molecules of the instant invention can be transformed into a many commercially useful plants. In a preferred embodiment of the invention, a transgenic plant expressing the desired protein is to be produced. In this case the desired protein may be operably linked to particular promoter controlling expression in a cell cycle regulated way. Various methods for the introduction of a desired polynucleotide sequence encoding the desired protein into plant cells are available and known to those of skill in the art and include, but are not limited to: (1) physical methods such as microinjection, electroporation, and microprojectile mediated delivery (biolistics or gene gun technology); (2) virus mediated delivery methods; and (3) *Agrobacterium*-mediated transformation methods.

The most commonly used methods for transformation of plant cells are the *Agrobacterium*-mediated DNA transfer process and the biolistics or microprojectile bombardment mediated process (i.e., the gene gun). Typically, nuclear transformation is desired but where it is desirable to specifically transform plastids, such as chloroplasts or amyloplasts, plant plastids may be transformed utilizing a microprojectile mediated delivery of the desired polynucleotide.

*Agrobacterium*-mediated transformation is achieved through the use of a genetically engineered soil bacterium belonging to the genus *Agrobacterium*. A number of wild-type and disarmed strains of *Agrobacterium tumefaciens* and *Agrobacterium rhizogenes* harboring Ti or Ri plasmids can be used for gene transfer into plants. Gene transfer is done via the transfer of a specific DNA known as "T-DNA" that can be genetically engineered to carry any desired piece of DNA into many plant species.

*Agrobacterium*-mediated genetic transformation of plants involves several steps. The first step, in which the virulent *Agrobacterium* and plant cells are first brought into contact with each other, is generally called "inoculation". Following the inoculation, the *Agrobacterium* and plant cells/tissues are permitted to be grown together for a period of several hours to several days or more under conditions suitable for growth and T-DNA transfer. This step is termed "co-culture". Following co-culture and T-DNA delivery, the plant cells are treated with bactericidal or bacteriostatic agents to kill the *Agrobacterium* remaining in contact with the explant and/or in the vessel containing the explant. If this is done in the absence of any selective agents to promote preferential growth of transgenic versus non-transgenic plant cells, then this is typically referred to as the "delay" step. If done in the presence of selective pressure favoring transgenic plant cells, then it is referred to as a "selection" step. When a "delay" is used, it is typically followed by one or more "selection" steps.

With respect to microprojectile bombardment (U.S. Pat. No. 5,550,318; U.S. Pat. No. 5,538,880; U.S. Pat. No. 5,610,042; and PCT Publication WO 95/06128; each of which is specifically incorporated herein by reference in its entirety), particles are coated with nucleic acids and delivered into cells by a propelling force. Exemplary particles include those comprised of tungsten, platinum, and preferably, gold.

An illustrative embodiment of a method for delivering DNA into plant cells by acceleration is the Biolistics Particle Delivery System (BioRad, Hercules, Calif.), which can be used to propel particles coated with DNA or cells through a screen, such as a stainless steel or Nytex screen, onto a filter surface covered with monocot plant cells cultured in suspension.

Microprojectile bombardment techniques are widely applicable, and may be used to transform virtually any plant species. Examples of species that have been transformed by microprojectile bombardment include monocot species such as maize (PCT Publication WO 95/06128), barley, wheat (U.S. Pat. No. 5,563,055, specifically incorporated herein by reference in its entirety), rice, oat, rye, sugarcane, and sorghum; as well as a number of dicots including tobacco, soybean (U.S. Pat. No. 5,322,783, specifically incorporated herein by reference in its entirety), sunflower, peanut, cotton, tomato, and legumes in general (U.S. Pat. No. 5,563,055, specifically incorporated herein by reference in its entirety).

To select or score for transformed plant cells regardless of transformation methodology, the DNA introduced into the cell contains a gene that functions in a regenerable plant tissue to produce a compound that confers upon the plant tissue resistance to an otherwise toxic compound. Genes of interest for use as a selectable, screenable, or scorable marker would include but are not limited to GUS, green fluorescent protein (GFP), luciferase (LUX), antibiotic or herbicide tolerance genes. Examples of antibiotic resistance genes include the penicillins, kanamycin (and neomycin, G418, bleomycin), methotrexate (and trimethoprim), chloramphenicol, kanamycin, and tetracycline.

The regeneration, development, and cultivation of plants from various transformed explants is well documented in the art. This regeneration and growth process typically includes the steps of selecting transformed cells and culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil. Cells that survive the exposure to the selective agent, or cells that have been scored positive in a screening assay, may be cultured in media that supports regeneration of plants. Developing plantlets are transferred to soil less plant growth mix, and hardened off, prior to transfer to a greenhouse or growth chamber for maturation.

The present invention can be used with any transformable cell or tissue. By transformable as used herein is meant a cell or tissue that is capable of further propagation to give rise to a plant. Those of skill in the art recognize that a number of plant cells or tissues are transformable in which after insertion of exogenous DNA and appropriate culture conditions the plant cells or tissues can form into a differentiated plant. Tissue suitable for these purposes can include but is not limited to immature embryos, scutellar tissue, suspension cell cultures, immature inflorescence, shoot meristem, nodal explants, callus tissue, hypocotyl tissue, cotyledons, roots, and leaves.

Any suitable plant culture medium can be used. Examples of suitable media would include but are not limited to MS-based media (Murashige and Skoog, Physiol. Plant, 15:473-497, 1962) or N6-based media (Chu et al., Scientia Sinica 18:659, 1975) supplemented with additional plant growth regulators including but not limited to auxins, cytokinins, ABA, and gibberellins. Those of skill in the art are familiar with the variety of tissue culture media, which when supplemented appropriately, support plant tissue growth and development and are suitable for plant transformation and regeneration. These tissue culture media can either be purchased as a commercial preparation, or custom prepared and modified. Those of skill in the art are aware that media and media supplements such as nutrients and growth regulators for use in transformation and regeneration and other culture conditions such as light intensity during incubation, pH, and incubation temperatures that can be optimized for the particular variety of interest.

The regeneration, development and cultivation of plants from single plant protoplast transformants or from various transformed explants is well known in the art. See generally, Maliga et al., *Methods in Plant Molecular Biology*, Cold Spring Harbor Press (1995); Weissbach and Weissbach, In: *Methods for Plant Molecular Biology*, Academic Press, San Diego, Calif. (1988). Plants of the present invention can be part of or generated from a breeding program, and may also be reproduced using apomixis. Methods for the production of apomictic plants are known in the art. See, e.g., U.S. Pat. No. 5,811,636.

The transgenic plant prepared in accordance with the invention may be of any generation, including a fertile or sterile $R_0$ transgenic plant as well as seeds thereof, and hybrid seed wherein the seed comprises a cell cycle regulated promoter operably linked to a cytokinin biosynthetic enzyme, e.g. isopentyl transferase. Also included within the invention are progeny plants of any generation of such a fertile $R_0$ transgenic plant as well as seed of a progeny plant.

Another aspect of the present invention relates to methods for obtaining nucleic acid molecule comprising a nucleotide sequence of the present invention. One method for obtaining a nucleic acid molecule encoding all or a substantial portion of the amino acid sequence of a protein encoded on the same gene as the sequences described herein would be: (a) probing a cDNA or genomic library with a hybridization probe comprising a nucleotide sequence encoding all or a substantial portion of a DNA, cDNA, or RNA molecule described herein (b) identifying a DNA clone that hybridizes under stringent conditions to the hybridization probe; (c) isolating the DNA clone identified in step (b); and (d) sequencing the cDNA or genomic fragment that comprises the clone isolated in step (c).

EXAMPLES

Example 1

Cloning and Vector Construction

The IPT gene (SEQ ID NO: 1 and 2) of 720 bp from *Agrobacterium tumefaciens* was amplified by PCR from plasmid pMON38210, using two primers that introduced a NcoI site at the 5' end and an EcoRI site at the 3' end of the amplified gene. The two primer sequences are CGCGGCCCATG-GATCTGCGTCTAATTTTCGGTCCAAC (Seq ID NO: 3) and CGGCGCGAATTCTAATACATTCCGAATGGATGA-CCTT (Seq ID NO: 4).

The promoter of *Arabidopsis* CycB1 (Seq ID NO: 5) was cloned by using the upstream DNA polynucleotide sequence of CycB1 from the genomic clone with Genbank number AL035601. Two primers were designed to amplify from the total genomic DNA the 1550 bp fragment immediately upstream from the ATG start codon, introducing a PacI site at the 5' end and a NcoI site at the 3' end. The two primer sequences are CGCGGCTTAATTAAGAGCAATAACAGT-GTGTGAGGCATT (SEQ ID NO: 6) and CGGCGCCCATG-GTCTTAGTGTTCTCTTCTCTTTCTCTC (SEQ ID NO: 7). To clone the promoter of *Arabidopsis* CycD3 (SEQ ID NO: 8), the upstream sequence of 1500 bp was determined from the genomic contig AL161585 (Genbank), which was then cloned by PCR using two primers that introduced a PacI site at the 5' end and a NcoI site at the 3' end. The primer sequences are: CGCGGCTTAATTAAGCATTATGCGGGA-GCAAAGGTAAGT (SEQ ID NO: 9) and CGGCGCCC-ATGGTGGGGGACTAAACTCAAGAATGAGAA (SEQ ID NO: 10). Similarly, to clone the promoter of CDC2a (SEQ ID NO: 11) from *Arabidopsis*, the corresponding 1400 bp upstream sequence was determined from AL132963 (Genbank number), and amplified from genomic DNA using two primers, introducing a AscI site at the 5' end and a NcoI site at the 3' end. The two primer sequences are: CGCGGCG-GCGCGCCATATATATTATTATATAAATATAAC (SEQ ID NO: 12) and CGCGGCCCATGGTTTCCTGAATAATAA-AGCTGAAG (SEQ ID NO: 13).

To construct the binary vector of IPT driven by the constitutive 35S promoter, the binary vector pMON23450 was linearized with NcoI and EcoRI, followed by ligation with the NcoI-EcoRI IPT fragment. The resulting vector was named pMON66507 (FIG. 8), in which the IPT gene is under the control of an enhanced 35S promoter (e35S). To put the IPT gene under the control of the CycB1 promoter, pMON66507 was digested with PacI and NcoI to release the e35S promoter, which was then replace by the PacI-NcoI P_CycB1 fragment. The resulting vector was named as pMON66508. Similarly, the PacI-NcoI P_CycD3 fragment was used to replace the e35S promoter in pMON66507 to generate the plasmid pMON66509, in which the IPT gene is under the control of the CycD3 promoter. To construct the IPT gene under the control of P_CDC2a, the amplified P_CDC2a fragment was digested with AscI and NcoI and ligated to pMON66507 that had the e35S promoter released by AscI and NcoI. The resulting plasmid was named as pMON66510.

Example 2

*Arabidopsis* Transformation

The constructed binary expression vectors from Example 1 were used to transform *Arabidopsis thaliana*, ecotype Columbia using an *Agrobacterium* mediated procedure.

Transformants were selected on kanamycin MS plates and thirty two independent transformation events were transferred to potted soil in growth chamber and grown to maturity for seed harvest. Expression of the IPT transgene was monitored at the transcript level using Taqman analysis.

Plant Growth

Seeds of the transgenic plants were sowed in potted soil along with wild-type plants (controls), and were vernalized at 4° C. for three days before moving to a growth chamber. The plants were grown under the following conditions: at 22° C., 24 hours constant light with light intensity of 170-200 µm Einstein $m^{-2}s^{-1}$, and a humidity of 70%. Plants were also grown under short day conditions, with 10 hours of light period. Plants were fertilized twice a week using Peters 20-20-20 fertilizer (in half strength) from Hummert International, Earth City, Mo.).

Example 3

Analysis of Gene Expression

RT-PCR Analysis

Total RNA was prepared from roots, rosette leaves and flowers of *Arabidopsis* plants using Trizol reagent from Life Technologies (Gibco BRL, Life Technologies, Gaithersburg, Md. U.S.A.). The RNA was then treated with DNAse and column purified. All samples were adjusted to same concentration based on spectrophotometer readings. 2.4 µg of total RNA was used to synthesize the first strand cDNA in a 20 µl reaction with SuperScript II-RT Kit (Life Technologies, Gaithersburg, Md.) according to the manufacture's procedure. An aliquot of 1 µl of the synthesized cDNA was used as template for PCR reaction (a total volume of 50 µl), using gene-specific primers. The reactions were limited to 20 cycles so the amplifications were still in linear range. The amplified PCR products were resolved on agarose gels and photographed.

Real-Time PCR (Taqman) Analysis

Two hole punches, or a piece of the youngest leaf tip approximately 1-cm long, were sampled from each *Arabidopsis thaliana* plant. The sampled tissue was placed in 96 well format boxes (1.1 ml micro tubes, VWR, Cat# 20901-027) with 4 mm parylene-coated stir balls (V&P Scientific, Cat#725E-1) on dry ice. Equal volumes of nucleic acid purification lysis solution (ABI, Cat#. 4305895) and Phosphate Buffered Saline (Life Technologies, Cat # 12394-011) were added. 0.40 ml of the Lysis buffer/PBS mixture (1:1 of 2×ABI Nucleic acid purification lysis solution and LifeTech Ca—Mg free 1×PBS) was added to each well, then tightly cap the tubes. The tissue was homogenized by shaking the samples with a Qiagen MixerMill-MM300 (Qiagen, Cat# 85110) for 5 minutes at 30 rev/sec. Particulate matter was removed using a 96 well QiaFilter (Qiagen, Cat# 10020). Genomic DNA was prepared using the Automated Nucleic Acid Workstation from Applied Biosystems (ABI, Cat#6700). 25 µl PCR reactions were prepared using the ABI 2× SYBR-Green PCR Master Mix, (ABI, Cat# 4304437) and 10 µl of template DNA prepared on the ABI6700. Primers used were purchased from Life Technologies and were used at the same concentration in all experiments.

Real-time thermo cycling was performed on the ABI 7700 with standard cycling conditions of: 50° C. for 2 minutes, 95° C. for 10 minutes, and 40 cycles of 95° C. for 20 seconds, 60° C. for 1 minute. Standard data analysis procedures were followed for baseline adjustment then the data was screened for two-fold standard deviation of variance. Results of these analysis are discussed below. IPT was differentially expressed among different promoters in transgenic plants.

Gene Expression Results.

Figure 1:
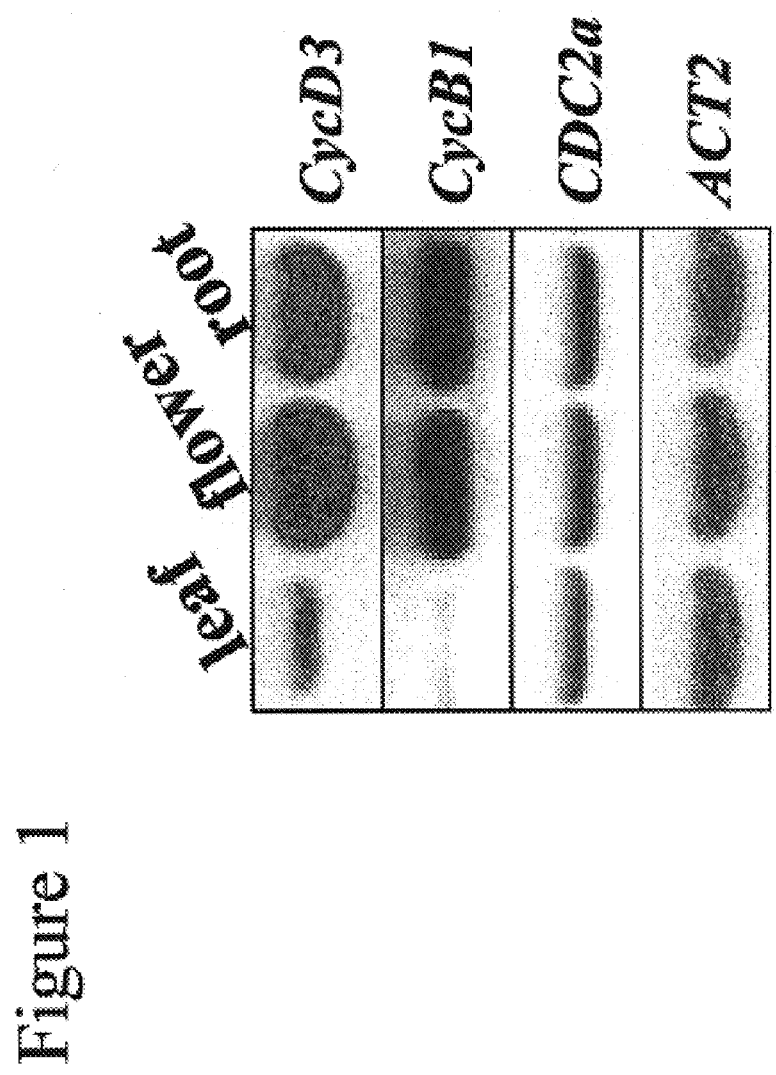
FIG. 1 shows a northern blot of the expression levels in roots, flowers, and leaves of plants containing in their genome an IPT gene under the control of CycD3, CycB1, and CDC2a. ACT is shown as loading control to show each lane is loaded with an equivalent amount of RNA.

Four promoters were used to drive the expression of IPT in transgenic *Arabidopsis* plants, CycD3, CycB1, CDC2a, as well as the constitutive e35S promoter. The CycB1 promoter, P_CycB1, is expressed at the G2/M phase. The CycD3 promoter, P_CycD3, is expressed throughout the cell cycle in dividing cells. Both P_CycB1 and P_CycD3 are therefore cell cycle promoters. CDC2a, encoding a cyclin-dependent kinase, is constitutively expressed throughout the cell cycle, and is expressed in certain non-dividing cells. We conducted a semi-quantitative RT-PCR assay on the expression patterns of these genes in wild-type *Arabidopsis* plants. As is shown in FIG. 1, CycD3 and CycB1 were most abundantly expressed in flower and root tissues, but were expressed at much reduced level in expanding leaves, with CycB1 only showing trace amount of leaf expression. In contrast, CDC2a was expressed at about same but relatively low level in the different tissues. Because expanding leaves have been shown to only have trace cell division activity, these results confirm that CDC2a expression is not tightly correlated with cell division.

Figure 2:
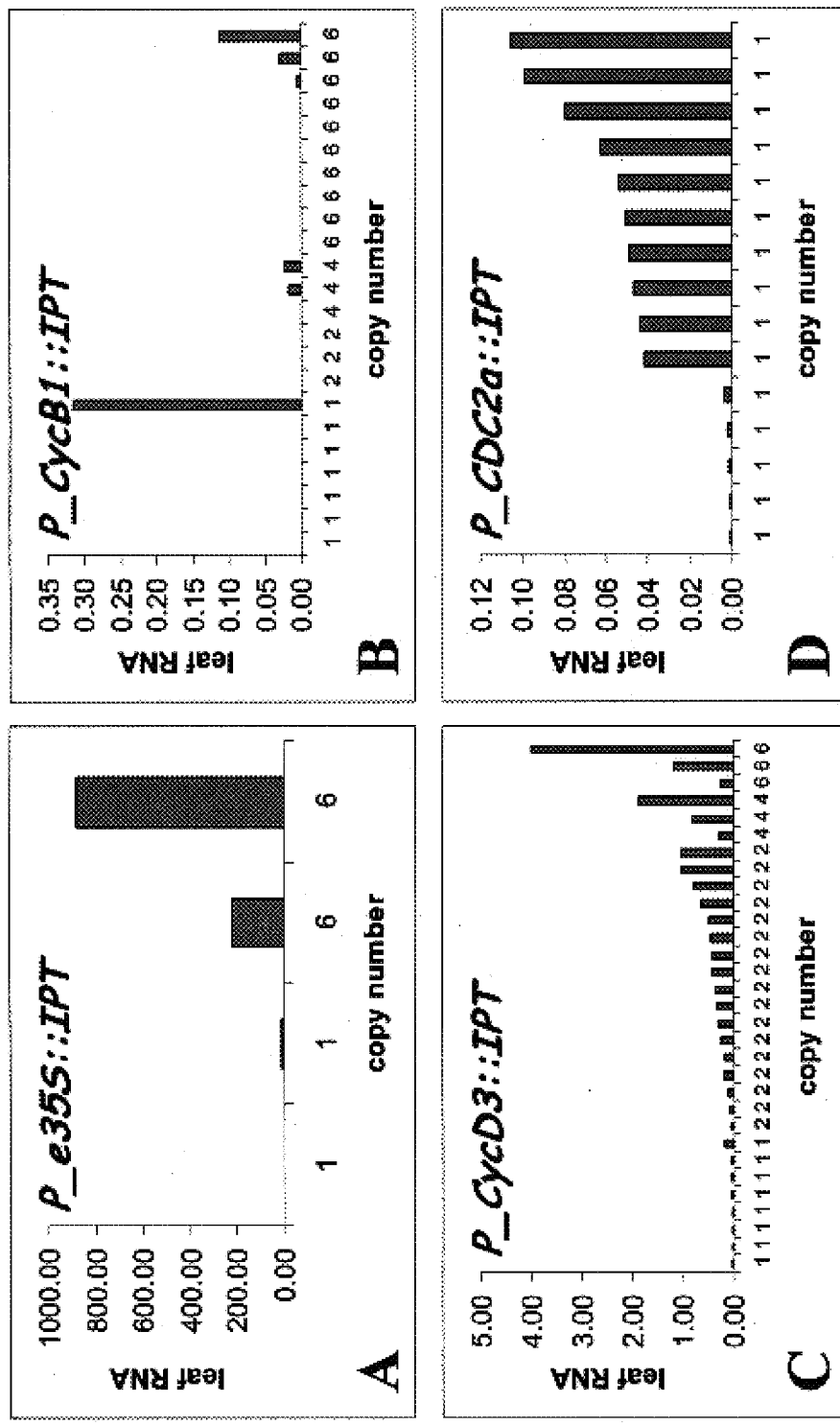
FIG. 2 shows the expression in leaf of plants with different copy numbers of transgene containing IPT under the control of different promoters. Quantitation was done using Taqman.

Transgenic *Arabidopsis* plants expressing IPT under the direction of the four different promoters were generated. Given the fact that all the promoters are capable of directing at least low levels of gene expression in leaves, we conducted transgene expression assays using the young leaf tissues from the transgenic plants. FIG. 2 shows the real-time quantitative RT-PCR, as well as the copy number determination (Taqman) of multiple independent transgenic plants expressing IPT from the four promoters. It is apparent that the strong promoter e35S led to high level IPT expression, while the promoters of CycD3, CycB1 and CDC2a resulted in significantly reduced expression. A comparison of the expression levels of the transgene driven by the promoters of CycB1, CycD3 and CDC2a showed that plants containing P_CycD3::IPT had the highest leaf expression level, whereas that of P_CycB1::IPT had the lowest. In the latter case, the one plant with a single copy of the transgene showing relatively high level of IPT expression is likely a result of transgene positional effect. Interestingly, although the CDC2a promoter is stronger than that of CycD3 in directing transcription in leaves (FIG. 1), the expression of IPT driven by CDC2a promoter was much lower than that driven by CycD3 promoter in the leaf tissues (FIGS. 2C and D); furthermore, while the IPT expression level of transgenic events driven by the promoter of CycD3 appeared to be positively correlated with the copy number of the transgene per genome, with more copies having higher level of transgene expression (FIG. 2C), all the transgenic plants expressing IPT driven by the CDC2a promoter contained only one copy of the transgene. This could at least partly suggest that high level of IPT expression by CDC2a promoter was deleterious, and only those with lower copy and thus lower expression had survived. Four independent transgenic events expressing IPT from the CDC2a promoter were advanced and their progeny analyzed for expression and transgene copy number. It was shown that 2 out of the 4 events resulted in progenies segregating 1:1 for 1 vs. 0 copy transgene, while the other two events had the majority of the progenies containing only one copy of the transgene, with a few plants missing the transgene (data not shown), which further suggest that, not only high level IPT by the CDC2a promoter was deleterious to the plant growth, but also the deleterious effect appeared to take place at gametophytic stage, resulting in the high occurrence of negative segregants.

Example 4

Collection of Traits and Phenotypes of Agronomic Interest

Methods

Seed Size Analysis

To determine the seed size of different transgenic plants, about 50 transgenic seeds (V2 and V3) were dispersed evenly in an area of about 0.5 cm in diameter on a flat surface, along with wild-type controls. Magnified Images were then taken and the image size in pixels was determined using the Image-Plus™ software. Four samples for each seed set were used in the analysis, and statistical significance of the seed size variation was determined by T-test.

A high throughput screen was also developed internally to determine the *Arabidopsis* seed size. The software is a UNIX command line image processing program that automatically segments images containing touching seeds, screens out non-seed subjects, and then measures the areas of seeds on TIF images. Using this program, seeds from about 600 independent transgenic events involving 21 vectors were assayed for seed size compared to wild-type controls. The *Arabidopsis* with cyclin promoters operably linked to IPT showed increased seed size. Detailed analysis is discussed in the results section of this example.

Canopy Size/Vegetative Growth Rate Determination.

Transgenic plants, along with wild-type controls, were arranged in Latin Square, with 12 plants for each genotype, and grown under uniform conditions. At days 25, 32 and 42, images were taken for each plants, and the canopy size of the one-dimensional image was determined with the Image-Plus software. Statistical significance of size variation was determined using T-test. The growth rate for a given genotype was determined by comparing the percentage of canopy size variation of that genotype to wild-type among different growth stages. The *Arabidopsis* with cyclin promoters operably linked to IPT showed increased canopy size/growth rate. Detailed analysis is discussed in the results section of this example.

Analysis of Other Plant Seed Weight Components.

When siliques were starting to turn yellow, individual plants were placed within transparent plastic cones to prevent tangling and thus facilitate seed collection. At maturity, both siliques and seeds were harvested and naturally dried for quantitative analysis, including seed weight per plant, silique number per plant and silique length. For silique length, 50 siliques were randomly selected from each plant, and the means were used for comparison. The *Arabidopsis* with cyclin promoters operably linked to IPT showed increased seed weight. Detailed analysis is discussed in the results section of this example.

Results.

IPT Expression in Non-Dividing Cells Led to Abnormal Plant Growth and Development.

Figure 3:
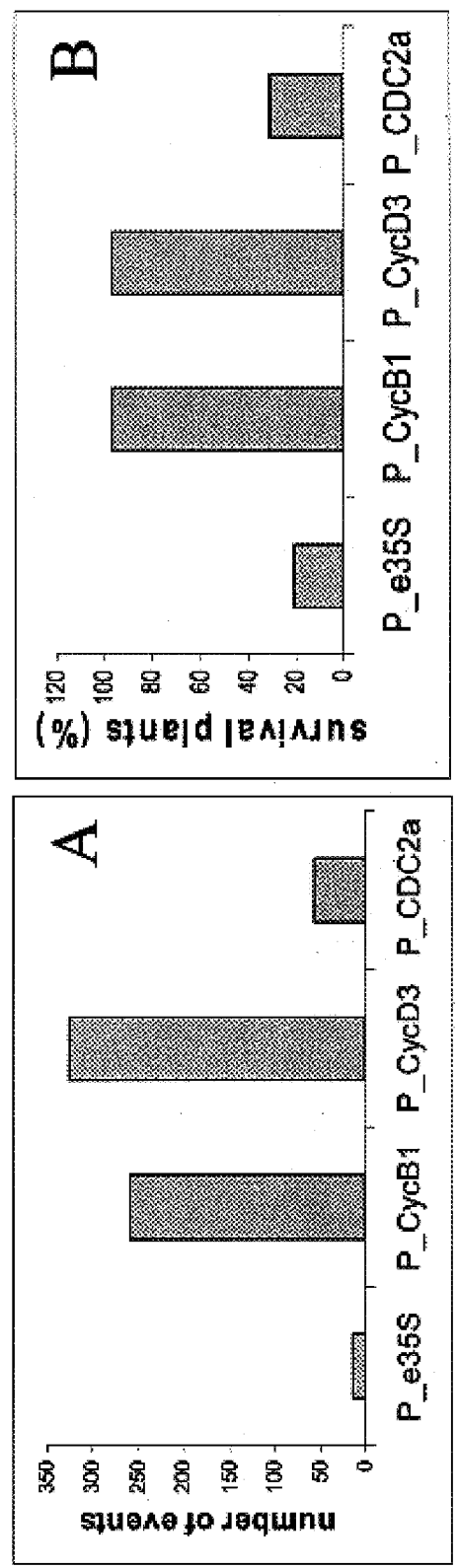
FIG. 3 shows the number of plants created with each transgene (panel A), and the percent survival of the plants (panel B).

The deleterious effect of non-specific IPT expression was manifested throughout the plant life cycle. When the transgenic seeds were plated on selection medium, seeds transformed with E35S::IPT and P_CDC2a::IPT exhibited much lower shoot regeneration rates when compared to those transformed with P_CycD3::IPT and P_CycB1::IPT. As is shown in FIG. 3A, with similar effort for each transgene, while we were able to generate more than 250 independent transgenic shoots transformed with P_CycB1::IPT (bar 2) and P_CycD3::IPT (bar 3), only 4 events for E35S::IPT (bar 1) and 50 events for P_CDC2a::IPT (bar 4) were generated. Furthermore, as is shown in FIG. 3B, the regenerated transgenic shoots survived differently, with E35S::IPT shoots (bar 1) having only one survive to maturity, which turned out to be the event with the lowest IPT expression; for P_CDC2a::IPT plants, only 25% of the shoots were able to grow to maturity (bar 4). In contrast, over 95% of the transgenic shoots of P_CycB1::IPT (bar 2) and P_CycD3::IPT (bar 3) developed and grew to maturity. The pleiotropic effect of the transgenes E35S::IPT involved a number of abnormalities (FIG. 4, Panel A), including the lack of root development, severely retarded shoot growth, extensive leaf curling and reproductive arrest. Most of the plants died before the flowering stage. A similar, though less severe, phenomenon was also observed for the transgenic plants of P_CDC2a:: IPT, with one third of the seedlings failed to set seeds as a result of retarded plant growth and development (FIG. 4, Panel B). Remarkably, the deleterious effect of P_CDC2a driven IPT expression became apparent at very early stages of plant development, as all the kanamycin resistant seedlings had very low level of IPT expression (FIG. 2). On the other hand, over 95% of the transgenic plants of P_CycB1::IPT (FIG. 3B, bar 2) and P_CycD3::IPT (bar 3) were developmentally normal throughout their life cycle (FIG. 6).

It has been shown previously that transgenic expression of IPT by various promoters resulted in deleterious pleiotropic effects on plant growth and development, the inventors reasoned that such pleiotrophs were likely due to the ectopic expression of IPT and consequently forced division in cells that were not committed to proper patterning after cell mass increase. Several lines of evidence from this study suggested that uncontrolled expression pattern, rather than the level of expression, was indeed a cause of the deleterious effect of the transgene on plant growth and development. First, a survey of the IPT transgene expression levels and the normality of plant growth and development when using the four different promoters showed that the transgenic plants were able to tolerate much higher level of IPT expression when the transgene was driven by the cell cycle-specific promoters P_CycD3 and P_CycB1 than that driven by non-specific promoters 35S and P_CDC2a (Table 1).

TABLE 1

Promoter- dependent leaf transgene RNA level and normal plant development.

| Transgene | Event number | Highest expression | Highest exp w/ normal develop |
|---|---|---|---|
| P_e35S::IPT | 4 | 882.00 | 0.02 |
| P_CDC2a::IPT | 32 | 0.11 | 0.11 |
| P_CycB1::IPT | 32 | 0.48 | 0.48 |
| P_CycD3::IPT | 32 | 3.99 | 3.99 |

Thus while only at very low level of IPT expression that the transgenic plants harboring E35S::IPT could grow and develop normally, they would display normal plant growth and development even at 200 folds increase in IPT expression when driven by the CycD3 promoter, suggesting not only that plant development is very sensitive to uncontrolled pattern of IPT expression, but also that the cells that had been programmed for cell division are a primary natural target of cytokinin for growth regulation, and can tolerate high levels of transgene expression without disrupting the subsequent organ patterning and formation.

Taking together, these results demonstrated that cytokinin expression in non-dividing cells in plants as shown by the IPT expression by P_CDC2a, had a pleiotropic effect, leading to abnormal plant growth and development. In contrast, cell cycle-specific IPT expression, directed by the promoters P_CycB1 and P_CycD3, were able to effectively eliminate the deleterious effects associated with uncontrolled IPT expression, and even at relatively high transgene expression level, the transgenic plants were able to grow and develop much like the wild-type plants.

Cyclin-Dependent IPT Expression Led to Accelerated Plant Growth Rate

The inventors further examined the effect of IPT expression from the different promoters used in this study on plant growth rate. The inventors wanted to determine whether amplified cytokinin expression in the natural cyclin-expressing cells would also lead to accelerated plant growth rate. To this end, the inventors conducted an experiment to quantify the morphological variations of transgenic plants compared to wild-type controls in the course of plant life cycle. FIG. 5 shows the accelerated plant growth rate of a typical transgenic plant of P_CycD3::IPT compared to a typical wild-type control plant. For example, at the age of 32 days, the transgenic plants of P_CycD3::IPT exhibited a critically significant (P<0.01) canopy size increase by 35% over that of the wild-type control (FIG. 5). Size comparison of leaves of the same position showed that the transgenic leaves were much larger than the wild-type control (FIG. 5A, lower panel). Noticeably, the degrees of canopy size increase varied along the growth stages, with the largest increase after about one month plant growth, and the increase declining at flowering. Thus the canopy size increase over wild-type control was 28%, 32% and 18% when measured at days 25, 32 and 42 after sowing, respectively (FIG. 5B Cell Cycle-Specific IPT Expression Led to Increased Organ Size, Organ Number and Overall Plant Productivity It was previously shown that, although the constitutive CycD2 expression could accelerate the growth rate of transgenic tobacco plants, the transgenic plants flowered earlier than the non-transformed plants, resulting in plants that are similar in size and overall productivity as compared to the wild-type controls at maturity. The inventors examined the organ size, organ number and overall plant productivity of transgenic *Arabidopsis* plants expressing IPT from the cell cycle-specific promoters. In contrast to over-expression of CycD2 by the 35S promoter, cell cycle-specific IPT expression, while accelerating the plant growth rate, did not alter the timing of developmental stages, with the transgenic plants flowering at the same time as the wild-type controls (FIG. 5A). Furthermore, by comparing to the wild-type control, It is clear that the transgenic plants, while developing normally, showed an overall enhanced productivity, including increased leaf size/vegetative mass (FIGS. 5A and B), increased plant height, increased branch number, increased flower and silique number (FIG. 6).

The inventors further examine all the transgenic events for the size of seeds, an organ in which CycD3, CycB1 and CDC2a in their native forms all express in wild-type *Arabidopsis* plants, and the size of which is mainly determined by cell cycle and the resulting cell number. The inventors developed an automated seed size (seed image area in pixels) screen and assayed the seed size of all the 70 independent transgenic lines that had been advanced, including 29 transgenic events of P_CycB1::IPT, 30 of P_CycD3.::IPT, 10 of P_CDC2a::IPT, and 1 of E35S::IPT. A power calculation has determined that, at high detection power of 95%, our standard operation protocol would be capable of detecting 9% seed size difference at critically significant level (P<0.01). Using 10% as the cut-off value, the inventors showed (FIG. 7) that 72% of the P_CycB1::IPT events and 63% of the P_CycD3::IPT events exhibited significant seed size increase, ranging from 10% to 70% size increase over wild-type controls. In contrast, none of the P_CDC2a::IPT nor E35S::IPT events exhibited significant seed size increase. These results demonstrate that the amplified expression of cytokinin in dividing cells not only eliminated the deleterious pleiotrophs associated with ectopic cytokinin expression, but also accelerated target organ growth and size with high phenotypic penetrance. The improvement of multiple attributes of the transgenic plants expressing IPT from the cell cycle-specific promoters, including increased silique/seed number and increased seed size, has led to the increased seed production of the transgenic plants.

Example 5

Constructs for Maize Transformation

A GATEWAY™ Destination (Invitrogen Life Technologies, Carlsbad, Calif.) plant expression vector, pMON65 154, was constructed for use in preparation of constructs comprising recombinant polynucleotides for corn transformation. The elements of the expression vector are summarized in Table 2 below. Generally, pMON65154 comprises a selectable marker expression cassette comprising a Cauliflower Mosaic Virus 35S promoter operably linked to a gene encoding neomycin phosphotransferase II (nptII). The 3' region of the selectable marker expression cassette comprises the 3' region of the *Agrobacterium tumefaciense* nopaline synthase gene (nos) followed 3' by the 3' region of the potato proteinase inhibitor II (pinII) gene. The plasmid pMON 65154 further comprises a plant expression cassette into which a gene of interest may be inserted using GATEWAY™ cloning methods. The GATEWAY™ cloning cassette is flanked 5' by a rice actin 1 promoter, exon and intron and flanked 3' by the 3' region of the potato pinII gene. Using GATEWAY™ methods, the cloning cassette may be replaced with a gene of interest. The vector pMON65154, and derivatives thereof comprising a gene of interest, are particularly useful in methods of plant transformation via direct DNA delivery, such as microprojectile bombardment.

TABLE 2

Elements of Plasmid pMON65154

| FUNCTION | ELEMENT | REFERENCE |
|---|---|---|
| Plant gene of interest expression cassette or other plant promoter | Rice actin 1 promoter, for example | U.S. Pat. No. 5,641,876 |
| | Rice actin 1 exon 1, intron 1 enhancer, for example | U.S. Pat. No. 5,641,876 |
| Gene of interest insertion site | AttR1 | GATEWAY ™ Cloning Technology Instruction Manual |
| | CmR gene | GATEWAY ™ Cloning Technology Instruction Manual |
| | ccdA, ccdB genes | GATEWAY ™ Cloning Technology Instruction Manual |
| | attR2 | GATEWAY ™ Cloning Technology Instruction Manual |
| Plant gene of interest expression cassette | Potato pinII 3' region | An el al. (1989) Plant Cell 1: 115-122 |
| Plant selectable marker expression cassette | CaMV 35S promoter | U.S. Pat. No. 5,858,742 |
| | nptII selectable marker | U.S. Pat. No. 5,858,742 |
| | nos 3' region | U.S. Pat. No. 5,858,742 |
| | PinII 3' region | An et al. (1989) Plant Cell 1: 115-122 |
| Maintenance in *E. coli* | ColE1 origin of replication | |
| | F1 origin of replication | |
| | Bla ampicillin resistance | |

A similar plasmid vector, pMON72472, is constructed for use in *Agrobacterium* mediated methods of plant transformation. pMON72472 comprises the gene of interest plant expression cassette, GATEWAY™ cloning, and plant selectable marker expression cassettes present in pMON65154. In addition, left and right T-DNA border sequences from *Agrobacterium* are added to the plasmid (Zambryski et al., (1982). The right border sequence is located 5' to the rice actin 1 promoter and the left border sequence is located 3' to the pinII 3' sequence situated 3' to the nptII gene. Furthermore, pMON72472 comprises a plasmid backbone to facilitate replication of the plasmid in both *E. coli* and *Agrobacterium tumefaciens*. The backbone has an oriV wide host range origin of DNA replication functional in *Agrobacterium*, a pBR322 origin of replication functional in *E. coli*, and a spectinomycin/stretptomycin resistance gene for selection in both *E. coli* and *Agrobacterium*. In this case the promoter of interest was a cell cycle regulated promoter, and the gene of interest was a gene regulating cytokinin.

Vectors similar to those described above may be constructed for use in *Agrobacterium* or microprojectile bombardment maize transformation systems where the rice actin 1 promoter in the plant expression cassette portion is replaced with other desirable promoters including, but not limited to a maize globulin 1 promoter, a maize oleosin promoter, a glutelin 1 promoter, an aldolase promoter, a zein Z27 promoter, a pyruvate orthophosphate dikinase (PPDK) promoter, a soybean 7S alpha promoter, a peroxiredoxin antioxidant (Per1) promoter and a CaMV 35S promoter. Protein coding segments are amplified by PCR prior to insertion into vectors such as described above. Primers for PCR amplification can be designed at or near the start and stop codons of the coding sequence, in order to eliminate most of the 5' and 3' untranslated regions. For GATEWAY cloning methods, PCR products are tailed with attB1 and attB2 sequences, purified then recombined into a destination vectors to produce an expression vector for use in transformation. For specifics on the recombinant DNA molecules transformed into crop plants see Table 4.

Example 6

Constructs for Soybean Transformation

Constructs for use in transformation of soybean may be prepared by restriction enzyme based cloning into a common expression vector. Elements of an exemplary common expression vector are shown in Table 3 below. Elements that could be cloned into recombinant DNA molecules (i.e. expression vectors)

TABLE 3

Elements of pMON74532

| Function | Element | Reference |
|---|---|---|
| Agro transformation | B-ARGtu.right border | Depicker, A. et al., (1982) Mol Appl Genet 1: 561-573 |
| Antibiotic resistance | CR-Ec.aadA-SPC/STR | |
| Represser of primers from the ColE1 plasmid | CR-Ec.rop | |
| Origin of replication | OR-Ec.oriV-RK2 | |
| Agro transformation | B-ARGtu.left border | Barker, R. F. et al., (1983) Plant Mol Biol 2: 335-350 |
| Plant selectable marker expression cassette | Promoter with intron and 5'UTR of *arabidopsis* act 7 gene (AtAct7) 5' UTR of *arabidopsis* act 7 gene Intron in 5'UTR of AtAct7 | McDowell et al., (1996) Plant Physiol. 111: 699-711. |
| | Transit peptide region of *Arabidopsis* EPSPS | Klee, H. J. et al., (1987) MGG 210: 437-442 |
| | Synthetic CP4 coding region with dicot preferred codon usage | U.S. Pat. No. 6,248,876 |
| | A 3' UTR of the nopaline synthase gene of *Agrobacterium tumefaciens* Ti plasmid | U.S. Pat. No. 5,858,742 |
| Plant gene of interest expression cassette | Promoter for 35S RNA from CaMV containing a duplication of the −90 to −350 region or other plant promoter Gene of interest insertion site | U.S. Pat. No. 5,322,938 |
| | Cotton E6 3' end | GenBank accession U30508 |

Vectors similar to that described above may be constructed for use in *Agrobacterium* mediated soybean transformation systems where the enhanced 35S promoter in the plant expression cassette portion is replaced with other desirable promoters including, but not limited to a napin promoter and an *Arabidopsis* SSU promoter. Protein coding segments are amplified by PCR prior to insertion into vectors such as described above. Primers for PCR amplification can be designed at or near the start and stop codons of the coding sequence, in order to eliminate most of the 5' and 3' untranslated regions. In this case the promoter of interest was a cell cycle regulated promoter, and the gene of interest was a gene regulating cytokinin. For specifics on the recombinant DNA molecules transformed into crop plants, see Table 4.

Example 6

Plant Transformation

Constructs used in plant transformation of corn and soybean include those in Table 4.

TABLE 4

This table shows the promoter gene combinations, and what crop they were transformed into.

| Crop | Promoter | Intron Gene |
|---|---|---|
| Corn | P_OsCycB (SEQ ID NO: 362) | hsp70 IPT (SEQ ID NO: 1) |
| Corn | P_ZmCycD3.2 (SEQ ID NO: 360) | hsp70 IPT (SEQ ID NO: 1) |
| Corn | P_OsCycD3.2 (SEQ ID NO: 364) | hsp70 IPT (SEQ ID NO: 1) |
| Corn | P_ZmCycB1 (SEQ ID NO: 363) | hsp70 IPT (SEQ ID NO: 1) |
| Corn | P_OsCycB1 (SEQ ID NO: 361) | hsp70 IPT (SEQ ID NO: 1) |
| Soybean | P_AtCycB1 (SEQ ID NO: 5) | IPT (SEQ ID NO: 1) |
| Soybean | P_AtCycD3 (SEQ ID NO: 8) | IPT (SEQ ID NO: 1) |

Maize Transformation

LH59 plants are grown in the greenhouse and ears and ears harvested. when the embryos are 1.5 to 2.0 mm in length. Ears were surface sterilized by spraying or soaking the ears in 80% ethanol, followed by air drying. Immature embryos were isolated from individual kernels on surface sterilized ears. Prior to inoculation of maize cells, *Agrobacterium* cells are grown overnight at room temperature. Immature maize embryos are inoculated with *Agrobacterium* shortly after excision, and incubated at room temperature with *Agrobacterium* for 5-20 minutes. Immature embryos are then co-cultured with *Agrobacterium* for 1 to 3 days at 23° C. in the dark.

Co-cultured embryos are transferred to selection media and cultured for approximately two weeks to allow embryogenic callus to develop. Embryogenic callus is transferred to culture medium containing 100 mg/L paromomycin and sub-cultured at about two week intervals. Transformants are recovered 6 to 8 weeks after initiation of selection.

For *Agrobacterium* mediated transformation of maize callus, immature embryos are cultured for approximately 8-21 days after excision to allow callus to develop. Callus is then incubated for about 30 minutes at room temperature with the *Agrobacterium* suspension, followed by removal of the liquid by aspiration. The callus and *Agrobacterium* are co-cultured without selection for 3-6 days followed by selection on paromomycin for approximately 6 weeks, with biweekly transfers to fresh media, and paromomycin resistant callus identified.

For transformation by microprojectile bombardment, immature maize embryos are isolated and cultured 3-4 days prior to bombardment. Prior to microprojectile bombardment, a suspension of gold particles is prepared onto which the desired DNA is precipitated. DNA is introduced into maize cells as described in U.S. Pat. No. 5,015,580 using the electric discharge particle acceleration gene delivery device. For microprojectile bombardment of LH59 pre-cultured immature embryos, 35% to 45% of maximum voltage is preferably used. Following microprojectile bombardment, tissue is cultured in the dark at 27° C.

Fertile transgenic plants are produced from transformed maize cells by transfer of. transformed callus to appropriate regeneration media to initiate shoot development. Plantlets are transferred to soil when they are about 3 inches tall and have roots (about four to 6 weeks after transfer to medium). Plants are maintained for two weeks in a growth chamber at 26° C., followed by two weeks on a mist bench in a greenhouse before transplanting to 5 gallon pots for greenhouse growth. Plants are grown in the greenhouse to maturity and reciprocal pollinations made with the inbred LH59. Seed is collected from plants and used for further breeding activities.

Transformation methods and materials for making transgenic plants of this invention, e.g. various media and recipient target cells, transformation of immature embryos and subsequent regeneration of fertile transgenic plants are disclosed in U.S. Pat. Nos. 6,194,636 and 6,232,526 and U.S. patent application Ser. No. 09/757,089, which are incorporated herein by reference.

Soybean Transformation

For *Agrobacterium* mediated transformation, soybean seeds are germinated overnight and the meristem explants excised. The meristems and the explants are placed in a wounding vessel. Soybean explants and induced *Agrobacterium* cells from a strain containing plasmid DNA with the gene of interest cassette and a plant selectable marker cassette are mixed no later than 14 hours from the time of initiation of seed germination and wounded using sonication. Following wounding, explants are placed in co-culture for 2-5 days at which point they are transferred to selection media for 6-8 weeks to allow selection and growth of transgenic shoots. Phenotype positive shoots are harvested approximately 6-8 weeks post bombardment and placed into selective rooting media for 2-3 weeks. Shoots producing roots are transferred to the greenhouse and potted in soil. Shoots that remain healthy on selection, but do not produce roots are transferred to non-selective rooting media for an additional two weeks. Roots from any shoots that produce roots off selection are tested for expression of the plant selectable marker before they are transferred to the greenhouse and potted in soil.

Descriptions of media useful for transformation and regeneration of soybean and a method employing microprojectile bombardment are described in U.S. Pat. No. 5,914,451, which is incorporated herein by reference.

SEQUENCE LISTING (364 sequences)

SEQ ID NO: 1 - DNA, 723 bp, Agrobacterium tumefaciens
  CDS (1)..(723)
atggatctgcgtctaattttcggtccaacttgcacaggaaagacgtcgaccgcggtagctcttgcccagcagactgggcttccagtcctttcgctcgatcgggtccaatgttgtcctcagctgtcaaccggaagcggacgaccaacagtggaagaactgaaaggaacgagccgtctataccttgatgatcggcctctggtgaagggtatcatcgcagccaagcaagctcatgaaaggctgatggggggggtgtataattatgaggcccacggcgggcttattcttgagggaggatctatctcgttgctcaagtgcatggcgcaaagcagttattggagtgcggattttcgttggcatattattcgccacgagttagcagacgaagagaccttcatgaacgtggccaaggccagagttaagcagatgttacgccctgctgcaggcctttctattatccaagagttggttgatctttggaaagagcctcggctgaggcccatactgaaagagatcgatggatatcgatatgccatgttgtttgctagccagaaccagatcacatccgatatgctattgcagcttgacgcagatatggaggataagttgattcatgggatcgctcaggagtatctcatccatgcacgccgacaagaacagaaattccctcgagttaacgcagccgcttacgacggattcgaaggtcatccattcggaatgtattag

SEQ ID NO: 2 - protein, 240 aa, Agrobacterium tumefaciens
MDLRLIFGPTCTGKTSTAVALAQQTGLPVLSLDRVQCCPQLSTGSGRPTVEELKGTSRLYLDDRPLVKGIIAAKQAHERLMGGVYNYEAHGGLILEGGSISLLKCMAQSSYWSADFRWHIIRHELADEETFMNVAKARVKQMLRPAAGLSIIQELVDLWKEPRLRPILKEIDGYRYAMLFASQNQITSDMLLQLDADMEDKLIHGIAQEYLIHARRQEQKFPRVNAAAYDGFEGHPFGMY

SEQ ID NO: 3 - DNA, 37 bp, Artificial
  Primer for DNA amplification
cgcggcccatggatctgcgtctaattttcggtccaac

SEQ ID NO: 4 - DNA, 37 bp, Artificial
  Primer for DNA amplification
cggcgcgaattctaatacattccgaatggatgacctt

SEQ ID NO: 5 - DNA, 1549 bp, Arabidopsis thalania CycB1 promoter
  misc_feature (705)..(705): n = a, g, t, or c
  misc_feature (1225)..(1225): n = a, g, t, or c
taagagcaataacagtgtgtgaggcatttggaacctattaagagaccacaaaaatgataagagagaacaatatcagttttgtcttggccaaaaagtccactgagtgcgtgtaaccgagttagatgtaccttgtatgtgcttgtttctgacacaaaaactgaactaaggggaatgacacaacctttgtatgcaaatccttgacccatttcaacacctccatgtgtcaccaaaacagtcccattggtgcaaacatgaacaagagcaccggcctgtaataataatatgtgttggagtaagtatcttaaaatccagattctagatttgcaagcaaaggtagtgcaatgctgagatttccaaggaagcttcatcttattcttttacctttaaagttcctcgagagatgactaaatttgaaagaaaaaggattcacttctaacatgattcatgaactttgtggtaaatgaatatgacaattgtgtgggaaccatagctacaccacaccatgcaatgtgcggaagagagtgagattaatgtgtgatgggatctttgcagttgaaagttcatctcctaaagtcaagaaaacattaaactaacaaaatgaggacaaacttttaccaattttcacatttatagaaaaatattcaactcactttgatttcttcaggggctcagctgaatctagttttcaatggttgcagaacaaantgaaaatgaaaattttagtatctcaaaatctagtttctattttttttggtgacattaatcaatgatttcaaaataactaaaaacctcagaataaactcaattccatcttaaaaccacacaactttcataaccgaggaatgacgaaaaacaaaataatagaggaggagcatcactactattttcatttttttagccaatcagagcgcaccagaaaacgcccactcgcaccaacctcgtgccacgcgctacagaccacgcccactcgcaccaacctcgcgttgagcgcgtgtcgtcgatttctgtaggggttaacccacaaaatcatgcttattttacatctactcgctttgtttccaaaacagtctcgagtgacttttttttttgtttttttttctctaaaccgcactaattctaatgcaaaccgaaccaaaatcaattttcatttcaaaaccatgtaaaccaaacggagatcaacatctaactaaccggatttaactagcaatctaattcacacaaatcntttttttttttttttttcctatatccttcacagtcaataaaaagaataagtgggccgttgtgacttcaaaatcccaatagtgaaaaagcccgatttcgcgtctctacagccgtaaggcccgtaacaagcccacgacctctaatttttcaaaaacaatcagaccgttggggttcatttattttctttaattttgtttttatttcttataaaacggctcatcgtcctcaagaagcctcctatatagaagacgcccccactacttagactttttctactacaaacctgagattttagtctgagagaaagagaagagaacactaagac

SEQ ID NO: 6 - DNA, 39 bp, Artificial
  Primer for DNA amplification
cgcggcttaattaagagcaataacagtgtgtgaggcatt

SEQ ID NO: 7 - DNA, 38 bp, Artificial
  Primer for DNA amplification
cggcgcccatggtcttagtgttctcttctctttctctc

SEQ ID NO: 8 - DNA, 1500 bp, Arabidopsis thaliana
taagcattatgcgggagcaaaggtaagtcgagcctcaattagcaacattggttaacatgttccattataaacaaaaggctaaacacacaatccactcttgtatgcagaaacataattacgggtctgcgccatcagcaccgtatgcacctcacgtacctcaatactcagcaccgccttctgcatctccgtattcaacagcaccaccatactctggaccatctctatacccacaagtacaacaataccctcagccatcaggataccctccagcttcagggtatcctcctcagccatctgcctatccacctccctcaacctcgggctaccctccgatcccttcagcttacccacctcctccgccatcctcagcttaccctcctcaaccataccctccgcaaccatcatattacccacaaggtaccttcctttctttcctgttctatgctgcaattgatcgcatttgcttgtctctaactatagtcagtggtggttgatcttttttcttcttgtttccaggtccatatccaggacaatacccacctcctccatactagagcgtttggcgtttagaatttgacgggaagtggtcatgatgtatagattatagttatggtgttttctagaatttggcagacgaatttctttgttttgttttttttatatcatcttccttgtgctattgctagcgtgatggttaatttttgagttggtcagtgaaacttattgagaagtttggatcttttcatgtttaaccagatcgcagattatattgaattattactctaaatccttggttttgtgtgttcatcatcctcttgagttaaaattatgttaaaaacaaaaaaaggttttggttctgtctttaactttaagaaacggaacttatcggcgtataatcatcgcacttgtgatcagatgcaattagaaaaaggttatttggtcaatgtatagcaatatctttaggttctaacaaaaacattattgttgacaaatagcccaaaagtagtagaatttagccgacagattttactgcactttggtttctcgatctctactccaaatgagtaaaaagtgggtaaagcgggaaacagcaaaagaaatcacacatttaataaaaaataaagaaaaagaaattccacattaaataatcacaacaagaaaaacaaataatatattagtaaaagacaaacgtaaaaaccatctctcggccttctctcataaatcaatctctcttcttatcactctccgaaacccacttccagctttttcctctctctttctctctctagtctctcttttgtagctctcccctgataagctaaccactgcacgtttccatagagaggaaagatgagtctctctccgagagattttctctctatcatcttatcttcttccgtgtaatgctctgagccaaaacccaataactaaatcaacaacaatatagaagagaagagaaagatcttatctttcttctcattcttgagtttagtcccccac

SEQ ID NO: 9 - DNA, 39 bp, Artificial
  Primer for DNA sequencing
cgcggcttaattaagcattatgcgggagcaaaggtaagt

SEQ ID NO: 10 - DNA, 38 bp, Artificial
  Primer for DNA amplification
cggcgcccatggtgggggactaaactcaagaatgagaa

SEQ ID NO: 11 - DNA, 1398 bp, Arabidopsis thaliana
ccatatatattattatataaatataactgctaaagactaaatttagatactaaaatcagcattgatgaagatccacatgaataagactcgtctcttaactcaacatttaacatatgattttcatattattgatcatttatctttgtgttggtccaaggtgccagactttattatttacattaaatgttgagttgtttactgacatattttttaattaaaacaactttcatattattgcccatttatattttggttggtcctccaaagacttacaggatacatatgtttctccattttcatttttatgatctaaaacgtctttttctaacttagattctaaatggttacagcaaaccggacatacaattttgcttgtcaaatggatcgttgagatagacaacaatccaatgtaaaaccaaaactcttgatttataattgggctgcaatgatttttttttggttcatataccattttataagatagcaaaccattttcatcataaaagatatatttttttatcattgaataccaatcaaacccggtataataaataaaattgtaccaaattaatgcggttaggtaaattcaatttattggaaattaaagaagagaaaaaaaaaataacgaacaaaatttccttgacacaaaaaaaaaaaaagaagaaagaaaaaacccttactctcaattagtcaatccccttccctagtcctcctctcttcaagcttttcacagaaaaccaccacccttctctctctaccgcctttttaccacagagaagagagaggatccgtcggtgtgctagtctcactgacactacatccgatcgtcgccggtaagttgatttcgttactctccgatcaatttcttttccggaggaggaacttgttttccgtgcgaaattctgacttgaactttgttgtcaattcatcaaacgctttatcttttctccatcttcaattatcttactgcttcgtcgctgatctctacttgttttcctccgttttgcattttcagtggcgtttcttagtgtttcactagatttagactggttttgcttgtgtgcgttttgtcatcagtgtttatgattgttcgctttagctctatgtttctatggatttgataatatatgagttcgctgctctggattcagctggcttgtttgattgttcattttcataattctgtccaaagaatcaaatccacagtagctcggatctgagattgatttgtttctttgcgtctttgtgtagatttgactttaattttgagattgttgtgtgctgatatacagcttaattaatatagcctctgatgtgttattatcgatgtgtcattatcaatctacaggtgacatcttataagtgtggagtttacttcagctttattattcaggaaac

SEQ ID NO: 12 - DNA, 39 bp, Artificial
  DNA primer for DNA amplification
cgcggcggcgcgccatatatattattatataaatataac

SEQ ID NO: 13 - DNA, 35 bp, Artificial
  Primer for DNA amplification
cgcggcccatggtttcctgaataataaagctgaag

SEQ ID NO: 14 - DNA, 720 bp, Dictyostelium discoideum
  CDS (1)..(720)
atggcaacaaaatcaaatgaagagaatattgcagaatttaaaggtcataatgaaattcaaattgaattaatgaaagaagaatgtattgtagttgataatgatgataaaccaattagaccaggatcaaagaaagaaactcatttaatggttaatattaataatggcttacttcatcgtgcattcagtattttcttattcaatggtgaaggtaaattattacttcaacaaagagcattagagaaaatcactttcccaggctattggacaaacactgtttgttctcatccactttggattgttggttctgaattagttgaagagaatgctcaaggtgttaaaatagctgcaaaaagaaaattaaatcatgaattaggtgtaccattagatcaagtcaatatcgatgatttcacttttatgactaaaattcattacaaatctgaatcaaaagaagatccacaatggggtgaacatgaaattgatcatattttaattatgcaaaaagatggtattacaattaatgctgaaccaaatgaagttatggactataaatatgtatcacaagaagaattagatcaattatttaaagatgaagatgaaggtaaagttaaagtaacaccttggtttagattaattgcattaaatcatttaaaaccatggtggaataatttaaataatttaaaaccattagttgaaccaacaaatacaattcatagatattaa

SEQ ID NO: 15 - protein, 239 aa, Dictyostelium discoideum
MATKSNEENIAEFKGHNEIQIELMKEECIVVDNDDKPIRPGSKKETHLMVNINNGLLHRAFSIFLFNGEGKLLLQQRALEKITFPGYWTNTVCSHPLWIVGSELVEENAQGVKIAAKRKLNHELGVPLDQVNIDDFTFMTKIHYKSESKEDPQWGEHEIDHILIMQKDGITINAEPNEVMDYKYVSQEELDQLFKDEDEGKVKVTPWFRLIALNHLKPWWNNLNNLKPLVEPTNTIHRY

SEQ ID NO: 16 - DNA, 723 bp, Agrobacterium vitis
  CDS (1)..(723)
atggatctgcgtctaattttcggtccaacttgcacaggaaagacgtcgaccgcgatacgtcttgcccagcagactggccttccagtcctttcgctcgatcgggtccaatgctgtcctcaactgtcaaccggaagcggacgaccaacagtggaagaactgaaaggaacgacccgtctataccttgaagatcggcctctggtgaagggtatcatcgcagccaagcaagctcacgaaaggctgatcggggaagtgtacaattatgaggcccacggcgggcttattcttgagggaggatctatctcgttgctcaggtgcatggcgcaaagcagttattggagtaccgattttcgttggcatattattcgccacaagttagcagacgaggagaccttcatgaacgcggccaaggccagagttaggcagatgttgcgccctgctgtaggcccatctattattcaagagttggttcatctttggaatgagcctcggctgaggcccatactgaaagagatcgacggatatcgatatgccatgttatttgctagccagaaccagatcacacccgatatgctattgcagcttgacccagatatggagggtgagttgattcatggaatcgctcaggagtatctcatccatgcgcgccggcaggagcaggaattccctccagtgagcgtggtcgctttcgaaggattcgaaggtccaccgttcggaatgtgctag

SEQ ID NO: 17 - protein, 240 aa, Agrobacterium vitis
MDLRLIFGPTCTGKTSTAIRLAQQTGLPVLSLDRVQCCPQLSTGSGRPTVEELKGTTRLYLEDRPLVKGIIAAKQAHERLIGEVYNYEAHGGLILEGGSISLLRCMAQSSYWSTDFRWHIIRHKLADEETFMNAAKARVRQMLRPAVGPSIIQELVHLWNEPRLRPILKEIDGYRYAMLFASQNQITPDMLLQLDPDMEGELIHGIAQEYLIHARRQEQEFPPVSVVAFEGFEGPPFGMC

SEQ ID NO: 18 - DNA, 723 bp, Agrobacterium vitis
  CDS (1)..(723)
atggatctgcgtctaattttcggtccaacttgcacaggaaagacgtcgacggcgatagctcttgcccagcagactgggcttccagtcctttcgctcgatcgggtccaatgctgtcctcagctgtcaaccggaagcggacgaccaacagtggaagaactgaaaggaacgacccgtctgtaccttgatgatcggcccctggtgaagggtatcatcgcagccgagcaagctcatgagaggctgatcgcggaggtgtataattatgaggcccacggcggacttattcttgagggaggatctatctcgttgctcaagtgcatggcgcaaagcggttattggagcgccgattttcgttggcatattattcgccacaagttagcagacgaggagaccttcatgaaagcggccaaggccagagttaagcagatgttgtgccccgctataggcccatctcttattcaagagttggtttatctttggaatgagcctcggctgaggcccatactgaaagagatcgatggatatcgatatgccatgttgtttgctagccagaatcggatcacgcccgatatgctattgcagcttgacgcagatatggagggtaagttgattcatgggatcgctcaggagtatctcatccatgcgcgtcggcaggaacacgaattcccgccggtgagcgcggcagctttcgaaggatttgaaggcccaccattcggagcgtactag

SEQ ID NO: 19 - protein, 240 aa, Agrobacterium vitis
MDLRLIFGPTCTGKTSTAIALAQQTGLPVLSLDRVQCCPQLSTGSGRPTVEELKGTTRLYLDDRPLVKGIIAAEQAHERLIAEVYNYEAHGGLILEGGSISLLKCMAQSGYWSADFRWHIIRHKLADEETFMKAAKARVKQMLCPAIGPSLIQELVYLWNEPRLRPILKEIDGYRYAMLFASQNRITPDMLLQLDADMEGKLIHGIAQEYLIHARRQEHEFPPVSAAAFEGFEGPPFGAY

SEQ ID NO: 20 - DNA, 723 bp, Agrobacterium tumefaciens; identical to SEQ ID NO: 1
  CDS (1)..(723)

SEQ ID NO: 21 - protein, 240 aa, Agrobacterium tumefaciens; identical to SEQ ID NO: 2

SEQ ID NO: 22 - protein, 423 aa, Aspergillus nidulans
MQMYRGLPIITNQIPVEERHGVPHHLISCIDLEENPWRISMFRRECLRLINDIHARGKLAVLVGGTHYYTQSVLFQDQLVSKELESSDEESDSCPAGDVDSAVKWPILNAEPELVLQKLREVDPIMADHWHPKDTRKIRRSLEIFFQTGKPASQVYAEQRQSKQANANNDNGSDWGQLRFDTAIFWVHSEKAILEERLFKRVDVMVEQGLLSEASRMSDYLQEQKAQGITVDQTRGVWISIGFKELAPYFNALREDSRTEKELETLKQSCIGSVKIATRQYAMSQLKWIRNKLWTGLAKGAMTGRLYILDSTKVEDWTKNVTEPSERIVEAHIGKKPLPDPKSISELAKTTFEALEAKSLSTDPSPSQCITCDICRKTLTNKEQWQIHINGSVHKRVLKSLAKKRERDAYLRKRQENLGNTLE

SEQ ID NO: 23 - protein, 471 aa, Aspergillus nidulans
  misc_feature (357)..(357): Xaa can be any naturally occurring amino acid
AMRSLIAVVGATGTGKSKLAVLAVDIASRFNGEVINGDAMQMYRGLPIITNQIPVEERHGVPHHLISCIDLEEKWRISMFRRECLRLINDIHARGKLAVLVGGTHYYTQSVLFQDQLVSKELESSDEESDSCPAGDEWPILNAEPELVLQKLREVDPIMADHWHPKDTRKIRRSLEIFFQTGKPASQVYAEQRQSKQGGQLRFDTAIFGQLRFDTAIFWVHSEKAILEERLFKRVDVMVEQGLLSEASRMSDYLQEQKAQGITVDQTRGVWISIGFKELAPYFNAQLETLKQSCIGSVKIATRQYAMSQLAPYFNAQLETLKQSCIGSVKIATRQYAMSQLKWIRNKLWTGLQKGLXPVACIFDSTKVEDWTKNVTEPSERIVEAHIGKPLPDPKSISELAKTTFEALEAKSLSTDPSPSQCITCDICRKTLTNKEQWQIHINGSVHKRVLKSLAKKRERDAYLRKRQENL

SEQ ID NO: 24 - protein, 619 aa, Arabidopsis thaliana
MQQLMTLLSPPLSHSSLLPTVTTKFGSPRLVTTCMGHAGRKNIKDKVVLITGTTGTGKSRLSVDLATRFFPAEIINSDKMQIYKGFEIVTNLIPLHEQGGVPHHLLGQFHPQDGELTPAEFRSLATLSISKLISSKKLPIVVGGSNSFNHALLAERFDPDIDPFSPGSSLSTICSDLRYKCCILWVDVLEPVLFQHLCNRVDQMIESGLVEQLAELYDPVVDSGRRLGVRKTIGVEEFDRYFRVYPKEMDKGIWDLARKAAYEETVKGMKERTCRLVKKQKEKIMKLIRGGWEIKRLDATAAIMAELNQSTAKGEGKNGREIWEKHIVDESVEIVKKFLLEADSFTFVPYPSGSCSFVEVSTAAFLQRVLKICSHISSNYLPRHLSFVPIINRIGDFDMGINSINDPSYLSRALAVSGVGNDSDWSFSSDSSDEEKDEDDNKEDDSVNGDSRVQRFGYYHDDDDKGISGSVPWLRRCSGSFGDLLDLGSSGVVKLWDNLDFNGEGSPVASFFSKCGSYSLLSSAVLLAAEKKGSDGLEVSAWDARVGFGVPALLAEWKQPGRLLGKIIRVDVGDVDKIYVGDDVEGEITVGDMRMVNGALTELTESEVERMVRRRRRRH

SEQ ID NO: 25 - protein, 342 aa, Arabidopsis thaliana
MQQLMTLLSPPLSHSSLLPTVTTKFGSPRLVTTCMGHAGRKNIKDKVVLITGTTGTGKSRLSVDLATRFFPAEIINSDKMQIYKGFEIVTNLIPLHEQGGVPHHLLGQFHPQDGELTPAEFRSLATLSISKLISSKKLPIVVGGSNSFNHALLAERFDPDIDPFSPGSSLSTICSDLRYKCCILWVDVLEPVLFQHLCNRVDQMIESGLVEQLAELYDPVVDSGRRLGVRKTIGVEEFDRYFRVYPKEMDKGIWDLARKAAYEETVKGMKERTCRLVKKQKEKIMKLIRGGWEIKRLDATAAIMAELNQSTAKGEGKNGREIWEKHIVDESVEIVKKFLLEV

SEQ ID NO: 26 - protein, 466 aa, Arabidopsis thaliana
MMMLNPSNGGIEGEKMKKKAKVVVIMGPTGSGKSKLAVDLASHFPVEIINADAMQIYSGLDVLTNKVTVDEQKGVPHHLLGTVSSDMEFTARDFRDFTVPLIEEIVSRNHIPVLVGGTHYYIQAVVSKFLLDDAAEDTEECCADVASVVDQDMVVESVFGRDDLSHGYELLKELDPVAANRIHPNNHRKINQYLSLHASRGVLPSKLYQGKTAENWGCINASRFDYCLICMDAETAVLDRYVEQRVDAMVDAGLLDEVYDIYKPGADYTRGLRQSIGVREFEDFLKIHLSETCAGHLTSLSNDDKVMKENLRKILNFPKDDKLRIMLEEAIDRVKLNTRRLLRRQKRRVSRLETVFGWNIHYIDATEYILSKSEESWNAQVVKPASEIIRCFLETETESGRDPTSGKSIERDLWTQYVCEACGNKILRGRHEWEHHKQGRTHRKRTTRHKNSQTYKNREVQEAEVN

SEQ ID NO: 27 - protein, 330 aa, Arabidopsis thaliana
MQNLTSTFVSPSMIPITSPRLRLPPPRSVVPMTTVCMEQSYKQKVVVIMGATGSGKSCLSIDLATRFSGEIVNSDKIQFYDGLKVTTNQMSILERCGVPHHLLGELPPDDSELTTSEFRSLASRSISEITARGNLPIIAGGSNSFIHALLVDRFDPKTYPFSSETSISSGLRYECCFLWVDVSVSVLFEYLSKRVDQMMESGMFEELAGFYDPRYSGSAIRAHGIHKTIGIPEFDRYFSLYPPERKQKMSEWDQARKGAYDEAVQEIKENTWRLAKKQIERIMKLKSSGWDIQRLDATPSFGRSSREIWDNTVLDESIKVVKRFLVKDKV

SEQ ID NO: 28 - protein, 329 aa, Arabidopsis thaliana
MKFSISSLKQVQPILCFKNKLSKVNVNSFLHPKEKVIFVMGATGSGKSRLAIDLATRFQGEIINSDKIQLYKGLDVLTNKVTPKECRGVPHHLLGVFDSEAGNLTATQYSRLASQAISKLSANNKLPIVAGGSNSYIEALVNHSSGFLLNNYDCCFIWVDVSLPVLNSFVSKRVDRMMEAGLLEEVREVFNPKANYSVGIRRAIGVPELHEYLRNESLVDRATKSKMLDVAVKNIKKNTEILACRQLKKIQRLHKKWKMSMHRVDATEVFLKRNVEEQDEAWENLVARPSERIVDKFYNNNNQLKNDDVEHCLAASYGGGSGSRAHNMI

SEQ ID NO: 29 - protein, 336 aa, Arabidopsis thaliana
MIMKISMAMCKQPLPPSPTLDFPPARFGPNMLTLNPYGPKDKVVVIMGATGTGKSRLSVDIATRFRAEIINSDKIQVHQGLDIVTNKITSEESCGVPHHLLGVLPPEADLTAANYCHMANLSIESVLNRGKLPIIVGGSNSYVEALVDDKENKFRSRYDCCFLWVDVALPVLHGFVSERVDKMVESGMVEEVREFFDFSNSDYSRGIKKAIGFPEFDRFFRNEQFLNVEDREELLSKVLEEIKRNTFELACRQREKIERLRKVKKWSIQRVDATPVFTKRRSKMDANVAWERLVAGPSTDTVSRFLLDIASRRPLVEASTAVAAAMERELSRCLVA

SEQ ID NO: 30 - protein, 318 aa, Arabidopsis thaliana
MKCNDKMVVIMGATGSGKSSLSVDLALHFKAEIINSDKMQFYDGLKITTNQSTIEDRRGVPHHLLGELNPEAGEVTAAEFRVMAAEAISEITQRKKLPILAGGSNSYIHALLAKSYDPENYPFSDHKGSICSELKYDCCFIWIDVDQSVLFEYLSLRLDLMMKSGMFEEIAEFHRSKKAPKEPLGIWKAIGVQEFDDYLKMYKWDNDMDKWDPMRKEAYEKAVRAIKENTFQLTKDQITKINKLRNAGWDIKKVDATASFREAIRAAKEGEGVAEMQRKIWNKEVLEPCVKIVRSHLDQPINYYYYYFYLLKRFLSLN

SEQ ID NO: 31 - protein, 330 aa, Arabidopsis thaliana
MKPCMTALRQVIQPLSLNFQGNMVDVPFFRRKDKVVFVMGATGTGKSRLAIDLATRFPAEIVNSDKIQVYKGLDIVTNKVTPEESLGVPHHLLGTVHDTYEDFTAEDFQREAIRAVESIVQRDRVPIIAGGSNSYIEALVNDCVDFRLRYNCCFLWVDVSRPVLHSFVSERVDKMVDMGLVDEVRRIFDPSSSDYSAGIRRAIGVPELDEFLRSEMRNYPAETTERLLETAIEKIKENTCLLACRQLQKIQRLYKQWKWNMHRVDATEVFLRRGEEADEAWDNSVAHPSALAVEKFLSYSDDHHLEGANILLPEISAVPPLPAAVAAISR

SEQ ID NO: 32 - protein, 463 aa, Arabidopsis thaliana
MVIGSGVFLTRTCYLRLQPPSLVLRRRFCAATTACSVPLNGNKKKKSEKEKVIVISGPTGAGKSRLAMELAKRLNGEIISADSVQVYKGLDVGSAKPSDSDRKVVPHHLIDILHPSQDYSVGQFYDDGRQATKDILNRGRVPIVTGGTGLYLRWFMYGKPDVPKPSPEVIAEAHDMLVGFQTEYNWDAAVELVVNAGDPKASSLPRNDWYRLRRSLEILKSTGSPPSSFRIPYDSFRVNLVAPDADDFLEDGSSADISIQNIETDLDYDFLCFFLSSPRVALYRSIDFRCEDMLSGPNGVLSEARWLLDLGLLPNSNPATRAIGYRQAMEYLLQCRRYEGESSPREFYAFLNKFQTASRNFAKRQMTWFRCEPMYHWLNASKPLDSILQCIYDAYESEAEMVEIPESLRMSKDVRDSREASELKGYRSKNRHFVRREDCSSVLEWIRSEGCKSEASCVESAIA

SEQ ID NO: 33 - protein, 466 aa, Arabidopsis thaliana; identical to SEQ ID NO: 26

SEQ ID NO: 34 - protein, 494 aa, Arabidopsis thaliana
MMMLNPSNGGIEGEKMKKKAKVVVIMGPTGSGKSKLAVDLASHFPVEIINADAMQIYSGLDVLTNKVTVDEQKGVPHHLLGTVSSDMEFTARDFRDFTVPLIEEIVSRNHIPVLVGGTHYYIQAVVSKFLLDDAAEDTEECCADVASVVDQDMVVESVFGRDDLSHGYELLKELDPVAANRIHPNNHRKINQYLSLHASRGVLPSKLYQGKTAENWGCINASRFDYCLICMDAETAVLDRYVEQRVDAMVDAGLLDEVYDIYKPGADYTRGLRQSIGVREFEDFLKIHLSETCAGHLTSLSNDDKVMKENLRKILNFPKDDKLRIMLEEAIDRVKLNTRRLLRRQKRRVSRLETVFGWNIHYIDATEYILSKSEESWNAQVVKPASEIIRCFLETETESGRDPTSGKSIERDLWTQYVCEACGNKILRGRHEWEHHKQGRTHRKRTTRHKNSQTYKNREVQEAEVKREEQLSKEIGEEWCCKVKKRSRDKLKEK

SEQ ID NO: 35 - protein, 461 aa, Arabidopsis thaliana
MKKKAKVVVIMGPTGSGKSKLAVDLASHFPVEIINADAMQIYSGLDVLTNKVTVDEQKGVPHHLLGTVSSDMEFTARDFRDFTVPLIEEIVSRNHIPVLVGGTHYYIQAVVSKFLLDDAAEDTEECCADVASVVDQDMVVESVFGRDDLSHGYELLKELDPVAANRIHPNNHRKINQYLSLHASRGVLPSKLYQGKTAEVDSFFLTSRQNWGCINASRFDYCLICMDAETAVLDRYVEQRVDAMVDAGLLDEVYDIYKPGADYTRGLRQSIGVREFEDFLKIHLSETCAGHLTSLSNDDKVMKENLRKILNFPKDDKLRIMLEEAIDRVKLNTRRLLRRQKRRVSRLETVFGWNIHYIDATEYILSKSEESWNAQVVKPASEIIRCFLETETESGRDPTSGKSIERDLWTQYVCEACGNKILRGRHEWEHHKQGRTHRKRTTRHKNSQTYKNREVQEAEVN

SEQ ID NO: 36 - protein, 495 aa, Arabidopsis thaliana
MMMLNPSNGGIEGEKMKKKAKVVVIMGPTGSGKSKLAVDLASHFPVEIINADAMQIYSGLDVLTNKVTVDEQKGVPHHLLGTVSSDMEFTARDFRDFTVPLIEEIVSRNHIPVLVGGTHYYIQVVSKFLLDDAAEDTEECCADVASVVDQDMVVESVVDQDMVVESVFGRDDLSHGYELLKELDPVAANRIHPNNHRKINQYLSLHASRGVLPSKLYQGKTAENWGCINASRFDYCLICMDAETAVLDRYVEQRVDAMVDAGLLDEVYDIYKPGADYTRGLRQSIGVREFEDFLKIHLSETCAGHLTSLSNDDKVMKENLRKILNFPKDDKLRIMLEEAIDRVKLNTRRLLRRQKRRVSRLKRRVSRLETVFGWNIHYIDATEYILSKSEESWNAQVVKPASEIIRCFLETETESGRDPTSGKSIERDLWTQYVCEACGNKILRGRHEWACGNKILRGRHEWEHHKQGRTHRKRTTRHKNSQTYKNREVQEAEVN

SEQ ID NO: 37 - protein, 297 aa, Arabidopsis thaliana
MVVIMGATGSGKSSLSVDLALHFKAEIINSDKMQFYDGLKITTNQSTIEDRRGVPHHLLGELNPEAGEVTAAEFRVMAAEAISEITQRKKLPILAGGSNSYIHALLAKSYDPENYPFSDHKGSICSELKYDCCFIWIDVDQSVLFEYLSLRLDLMMKSGMFEEIAEFHRSKKAPKEPLGIWKAIGVQEFDDYLKMYKWDNDMDKWDPMRKEAYEKAVRAIKENTFQLTKDQITKINKLRNAGWDIKKVDATASFREAIRAAKEGEGVAEMQRKIWNKEVLEPFNKDSFPREIVNIIS

SEQ ID NO: 38 - protein, 288 aa, Arabidopsis thaliana
MVVIMGATGSGKSSLSVDLALHFKAEIINSDKMQFYDGLKITTNQSTIEDRRGVPHHLLGELNPEAGEVTAAEFRVMAAEAISEITQRKKLPILAGGSNSYIHALLAKSYDPENYPFSDHKGSICSELKYDCCFIWIDVDQSVLFEYLSLRLDLMMKSGMFEEIAEFHRSKKAPKEPLGIWKAIGVQEFDDYLKMYKWDNDMDKWDPMRKEAYEKAVRAIKENTFQLTKDQITKINKLRNAGWDIKKVDATASFREAIRAAKEGEGVAEMQRKIWNKEVLEPTHSLAK

SEQ ID NO: 39 - protein, 318 aa, Arabidopsis thaliana; identical to SEQ ID NO: 30

SEQ ID NO: 40 - protein, 422 aa, Arabidopsis thaliana
MVIGSGVFLTRTCYLRLQPPSLVLRRRFCAATTACSVPLNGNKKKKSEKEKVIVISGPTGAGKSRLAMELAKRLNGEIISADSVQVLAFVLPQSQVYKGLDVGSAKPSDSDRKVVPHHLIDILHPSQDYSVGQFYDDGRQATKDILNRGRVPIVTGGTGLYLRWFMYGKPDVPKPSPEVIAEAHDMLVGFQTEYNWDAAVELVVNAGDPKASSLPRNDWYRLRRSLEILKSTGSPPSSFRIPYDSFRVNLVAPDADDFLEDGSSADISIQNIETDLDYDFLCFFLSSPRVALYRSIDFRCEDMLSGPNGVLSEARWLLDLGLLPNSNPATRAIGNFAKRQMTWFRCEPMYHWLNASKPLDSILQCIYDAYESEAEMVEIPESLRMSKDVRDSREASELKGYRSKNRSEGCKSEASCVESAIA

SEQ ID NO: 41 - protein, 463 aa, Arabidopsis thaliana; identical to SEQ ID NO: 32

SEQ ID NO: 42 - protein, 466 aa, Arabidopsis thaliana
MVIGSGVFLTRTCYLRLQPPSLVLRRRFCAATTACSVPLNGNKKKKSEKEKVIVISGPTGAGKSRLAMELAKRLNGEIISADSVQVYKGLDVGSAKPSDSDRKVVPHHLIDILHPSQDYSVGQFYDDGRQATKDILNRGRVPIVTGGTGLYLRWFMYGKPDVPKPSPEVIAEAHDMLVGFQTEYNWDAAVELVVNAGDPKASSLPRNDWYRLRRSLEILKSTGSPPSSFRIPYDSFRVNLVAPDADDFLEDGSSADISIQNIETDLDYDFLCFFLSSPRVALYRSIDFRCEDMLSGPNGVLSEARWLLDLGLLPNSNPATRAIGYRQAMEYLLQCRRYEGESSPREFYAFLNKFQTASRNFAKRQMTWFRCEPMYHWLNASKPLDSILQCIYDAYESEAEMVEIPESLRMSKDVRDSREASELKGYRSKNRHFVHFVRREDCSSVLEWIRSEGCKSEASCVESAIA

SEQ ID NO: 43 - protein, 447 aa, Arabidopsis thaliana
MVIGSGVFLTRTCYLRLQPPSLVLRRRFCAATTACSVPLNGNKKKKSEKEKVIVISGPTGAGKSRLAMELAKRLNGEIISADSVQVYKGLDVGSAKPSDSDRKVVPHHLIDILHPSQDYSVGQFYDDGRQATKDILNRGRVPIVTGGTGLYLRWFMYGKPDVPKPSPEVIAEAHDMLVGFQTEYNWDAAVELVVNAGDPKASSLPRNDWYRLRRSLEILKSTGSPPSSFRIPYDSFRVNLVAPDADDFLEDGSSADISIQNIETDLDYDFLCFFLSSPRVALYRSIDFRCEDMLSGPNGVLSEARWLLDLGLLPNSNPATRAIGYRQAMEYLLQCRRYEGESSPREFYAFLNKFQTASRNFAKRQMTWFRCEPMYHWLNASKPLDSILQCIYDAYESEAEMVEIPESLRMSKDVRDSREASELKGYRSKNRSEGCKSEASCVESAIA

SEQ ID NO: 44 - protein, 342 aa, Arabidopsis thaliana; identical to SEQ ID NO: 25

SEQ ID NO: 45 - protein, 369 aa, Arabidopsis thaliana
MRWRLEIDRRRLRKKENEEDGENNTLLRGTQISRCQTPRLPRVKEVEVNGKVYVVLSSLAQVAMFWRKNIKDKVVLITGTTGTGKSRLSVDLATRFFPAEIINSDKMQIYKGFEIVTNLIPLHEQGGVPHHLLGQFHPQDGELTPAEFRSLATLSISKLISSKKLPIVVGGSNSFNHALLAERFDPDIDPFSPGSSLSTICSDLRYKCCILWVDVLEPVLFQHLCNRVDQMIESGLVEQLAELYDPVVDSGRRLGVRKTIGVEEFDRYFRVYPKEMDKGIWDLARKAAYEETVKGMKERTCRLVKKQKEKIMKLIRGGWEIKRLDATAAIMAELNQSTAKGEGKNGREIWEKHIVDESVEIVKKFLLEV

SEQ ID NO: 46 - protein, 329 aa, Arabidopsis thaliana; identical to SEQ ID NO: 28

SEQ ID NO: 47 - protein, 299 aa, Arabidopsis thaliana
MTTVCMEQSYKQKVVVIMGATGSGKSCLSIDLATRFSGEIVNSDKIQFYDGLKVTTNQMSILERCGVPHHLLGELPPDDSELTTSEFRSLASRSISEITARGNLPIIAGGSNSFIHALLVDRFDPKTYPFSSETSISSGLRYECCFLWVDVSVSVLFEYLSKRVDQMMESGMFEELAGFYDPRYSGSAIRAHGIHKTIGIPEFDRYFSLYPPERKQKMSEWDQARKGAYDEAVQEIKENTWRLAKKQIERIMKLKSSGWDIQRLDATPSFGRSSREIWDNTVLDESIKVVKRFLVKDKV

SEQ ID NO: 48 - protein, 330 aa, Arabidopsis thaliana; identical to SEQ ID NO: 27

SEQ ID NO: 49 - protein, 330 aa, Arabidopsis thaliana; identical to SEQ ID NO: 31

SEQ ID NO: 50 - protein, 330 aa, Arabidopsis thaliana
MAMCKQPLPPSPTLDFPPARFGPNMLTLNPYGPKDKVVVIMGATGTGKSRLSVDIATRFRAEIINSDKIQVHQGLDIVTNKITSEESCGVPHHLLGVLPPEADLTAANYCHMANLSIESVLNRGKLPIIVGGSNSYVEALVDDKENKFRSRYDCCFLWVDVALPVLHGFVSERVDKMVESGMVEEVREFFDFSNSDYSRGIKKAIGFPEFDRFFRNEQFLNVEDREELLSKVLEEIKRNTFELACRQREKIERLRKVKKWSIQRVDATPVFTKRRSKMDANVAWERLVAGPSTDTVSRFLLDIASRRPLVEASTAVAAAMERELSRCLVA

SEQ ID NO: 51 - protein, 336 aa, Arabidopsis thaliana; identical to SEQ ID NO: 29

SEQ ID NO: 52 - protein, 320 aa, Arabidopsis thaliana
MEQSRSRNRKDKVVVILGATGAGKSRLSVDLATRFPSEIINSDKIQVYEGLEITTNQITLQDRRGVPHHLLGVINPEHGELTAGEFRSAASNVVKEITSRQKVPIIAGGSNSFVHALLAQRFDPKFDPFSSGSCLISSDLRYECCFIWVDVSETVLYEYLLRRVDEMMDSGMFEELSRFYDPVKSGLETRFGIRKAIGVPEFDGYFKEYPPEKKMIKWDALRKAAYDKAVDDIKRNTWTLAKRQVKKIEMLKDAGWEIERVDATASFKAVMMKSSSEKKWRENWEEQVLEPSVKIVKRHLSAEMLCIEKKATAWRESFCI

SEQ ID NO: 53 - protein, 357 aa, Arabidopsis thaliana
MTELNFHLLPIISDRFTTTTTTSPSFSSHSSSSSSLLSFTKRRRKHQPLVSSIRMEQSRSRNRKDKVVVILGATGAGKSRLSVDLATRFPSEIINSDKIQVYEGLEITTNQITLQDRRGVPHHLLGVINPEHGELTAGEFRSAASNVVKEITSRQKVPIIAGGSNSFVHALLAQRFDPKFDPFSSGSCLISSDLRYECCFIWVDVSETVLYEYLLRRVDEMMDSGMFEELSRFYDPVKSGLETRFGIRKAIGVPEFDGYFKEYPPEKKMIKWDALRKAAYDKAVDDIKRNTWTLAKRQVKKIEMLKDAGWEIERVDATASFKAVMMKSSSEKKWRENWEEQVLEPSVKIVKRHLVQN

SEQ ID NO: 54 - protein, 197 aa, Brassica napus
IAASNAVSDITSRKKLPIIAGGSNTLVHALLAERFDPKIDPFGSSSISRELRYNCCFIWVDVSETVLFEYLLKRVDDMMGSGMFEELSRFYDPVKASTTRVGIRKAIGVPEFDGYFKMYPPEKEGEWDSGRRAAYDKVVEEIKENTLRLAKRQVVKIEKLRDAGWDIKRVDATASFSAVMMGRRREWREIWADAWVD

SEQ ID NO: 55 - protein, 66 aa, Brassica napus
  misc_feature (20)..(20): Xaa can be any naturally occurring amino acid
  misc_feature (26)..(26): Xaa can be any naturally occurring amino acid
LTVDPVTRLHAEIINSDKMXSLQEIXVTKNQTTMREGRGISHHLLCQLFQERRRIKYGEVCDAPAL

SEQ ID NO: 56 - protein, 168 aa, Arabidopsis thaliana
MVIGSGVFLTRTCYLRLQPPSLVLRRRFCAATTACSVPLNGNKKKKSEKEKVIVISGPTGAGKSRLAMELAKRLNGEIISADSVQVYKGLDVGSAKPSDSDRKVVPHHLIDILHPSQDYSLGQFYDDGRQATKDILNRGRVPIVTGGTGLYLRWFMYGKPDVPKPSPG

SEQ ID NO: 57 - protein, 118 aa, Arabidopsis thaliana
MKFSISSLKQVQPILCFKNKLSKVNVNSFLHPKEKVIFVMEATGSGKSRLAIDLATRFQGEIINSDKIQLYKGLDVLTNKVTPKECRGVPHHLLGVFDSEAGNLTATQYSRLASQAIS

SEQ ID NO: 58 - protein, 110 aa, Triticum aestivum
  misc_feature (49)..(49): Xaa can be any naturally occurring amino acid
  misc_feature (105)..(105): Xaa can be any naturally occurring amino acid
MPHLAAPASPPPAPNLMSDAREAASSSPPSERGRRKAVVVVMGATGAGXSRLAVDLARHFAGVEVVSADSMQVYRGLDVLTNEVSLDEQNGGPHPSPSIVDPSVXVTCPI

SEQ ID NO: 59 - protein, 357 aa, Arabidopsis thaliana; identical to SEQ ID NO: 53

SEQ ID NO: 60 - protein, 119 aa, Arabidopsis thaliana
  misc_feature (31)..(31): Xaa can be any naturally occurring amino acid
  misc_feature (82)..(82): Xaa can be any naturally occurring amino acid
  misc_feature (107)..(107): Xaa can be any naturally occurring amino acid
  misc_feature (111)..(111): Xaa can be any naturally occurring amino acid
  misc_feature (114)..(114): Xaa can be any naturally occurring amino acid
MVIGSGVFLTRTCYLRLQPPSLVLRRRFCAXTTACSVPLNGNKKKKSEKEKVIVISGPTGAGKSRLAMELAKRLNGEIISAXSVQVYKGLDVGSAKPSDSDRKVVPXHLIXILXPSQDY

SEQ ID NO: 61 - protein, 139 aa, Arabidopsis thaliana
  misc_feature (31)..(31): Xaa can be any naturally occurring amino acid
  misc_feature (131)..(131): Xaa can be any naturally occurring amino acid
MVIGSGVFLTRTCYLRLQPPSLVLRRRFCAXTTACSVPLNGNKKKKSEKEKVIVISGPTGAGKSRLAMELAKRLNGEIISADSVQVYKGLDVGSAKPSDSDRKVVPHHLIDILHPSQDYSVGQFYDDGRQXTKDILNRG

SEQ ID NO: 62 - protein, 115 aa, Arabidopsis thaliana
  misc_feature (31)..(31): Xaa can be any naturally occurring amino acid
  misc_feature (99)..(99): Xaa can be any naturally occurring amino acid
  misc_feature (105)..(105): Xaa can be any naturally occurring amino acid
  misc_feature (107)..(107): Xaa can be any naturally occurring amino acid
  misc_feature (112)..(112): Xaa can be any naturally occurring amino acid
MVIGSGVFLTRTCYLRLQPPSLVLRRRFCAXTTACSVPLNGNKKKKSEKEKVIVISGPTGAGKSRLAMELAKRLNGEIISADSVQVYKGLDVGSAKPSXSDRKVXVXHHLIXILH

SEQ ID NO: 63 - protein, 118 aa, Arabidopsis thaliana
  misc_feature (88)..(88): Xaa can be any naturally occurring amino acid
MTELNFHLLPIISDRFTTTTTTSPSFSSHSSSSSSLLSFTKRRRKHQPLVSSIRMEQSRSRNRKDKVVVILGATGAGKSRLSVDLATXFPSEIINSDKIQVYEGLEITTNQITLQDRR

SEQ ID NO: 64 - protein, 180 aa, Arabidopsis thaliana
SNSFVHALLAQRFDPKFDPFSSGSCLISSDLLYECCFIWVDVSETVLYEYLLRRVDEMMDSGMFEELSRFYDPVKSGLETRFGIRKAIGVPEFDGYFKEYPPEKKMIKWDALRKAAYDKAVDDIKRNTWTLAKRQVKKIEMLKDAGWEIERVDATASFKAVMMKSSSEKKWREIWEEQVL

SEQ ID NO: 65 - protein, 228 aa, Arabidopsis thaliana
LNSDKIQVYEGLEITTNQITLQDRRGVPHHLLGVINPEHGELTAGEFRSAASNVVKEITSRQKVPIIAGGSNSFVHALLAQRFDPKFDPFSSGSCLISSDLLYECCFIWVDVSETVLYEYLLRRVDEMMDSGMFEELSRFYDPVKSGLETRFGIRKAIGVPEFDGYFKEYPPEKKMIKWDALRKAAYDKAVDDIKRNTWTLAKRQVKKIEMLKDAGWEIERVDATASF

SEQ ID NO: 66 - protein, 181 aa, Arabidopsis thaliana
MTELNFHLLPIISDRFTTTTTTSPSFSSHSSSSSSLLSFTKRRRKHQPLVSSIRMEQSRSRNRKDKVVVILGATGAGKSRLSVDLATRFPSEIINSDKIQVYEGLEITTNQITLQDRRGVPHHLLGVINPEHGELTAGEFRSAASNVVKEITSRQKVPIIAGGSNSFVHALLAQRFDPKLE

SEQ ID NO: 67 - protein, 86 aa, Arabidopsis thaliana
  misc_feature (3)..(4): Xaa can be any naturally occurring amino acid
RLXXEYPPEKKMIKWDALRKAAYDKAVDDIKRNTWTLAKRQVKKIEMLKDAGWEIERVDATASFKAVMMKSSSEKKWREIWEEQVL

SEQ ID NO: 68 - protein, 130 aa, Arabidopsis thaliana
MVIGSGVFLTRTCYLRLQPPSLVLRRRFCAATTACSVPLNGNKKKKSEKEKVIVISGPTGAGKSRLAMELAKRLNGEIISADSVQVYKGLDVGSAKPSDSDRKVVPHHLIDILHPSQDYSLGQFYDDGRQ

SEQ ID NO: 69 - protein, 127 aa, Arabidopsis thaliana
  misc_feature (31)..(31): Xaa can be any naturally occurring amino acid
  misc_feature (37)..(38): Xaa can be any naturally occurring amino acid
  misc_feature (107)..(107): Xaa can be any naturally occurring amino acid
MVIGSGVFLTRTCYLRLQPPSLVLRRRFCAXTTACSXXLNGNKKKKSEKEKVIVISGPTGAGKSRLAMELAKRLNGEIISADSVQVYKGLDVGSAKPSDSDRKVVPXHLIYILHPSQDYSVGQFYDD

SEQ ID NO: 70 - protein, 150 aa, Zea mays subsp. mays
MAHPSAAAVSSTALAANPSSGASEEGGARSPPSPSQRGRAKVVIVMGATGAGKSRLAVDLAAHFAGVEVVSADSMQLYRGLDVLTNKAPLHEQNGVPHHLLSVIDPSVEFTCRDFRDRALPIIQEIVDRGGVPVVVGGTNFYIQALVSPF

SEQ ID NO: 71 - protein, 104 aa, Arabidopsis thaliana
  misc_feature (31)..(31): Xaa can be any naturally occurring amino acid
  misc_feature (88)..(88): Xaa can be any naturally occurring amino acid
  misc_feature (98)..(98): Xaa can be any naturally occurring amino acid
MVIGSGVFLTRTCYLRLQPPSLVLRRRFCAXTTACSVPLNGNKKKKSEKEKVIVISGPTGAGKSRLAMELAKRLNGEIISADSVQVYXGLDVGSAKPXSDSDRK

SEQ ID NO: 72 - protein, 168 aa, Zea mays subsp. mays
  misc_feature (160)..(160): Xaa can be any naturally occurring amino acid
  misc_feature (162)..(162): Xaa can be any naturally occurring amino acid
MAHPSAAAVSSTALAANPSSGASEEGGARSPPSPSQRGRAKVVIVMGATGAGKSRLAVDLAAHFAGVEVVSADSMQLYRGLDVLTNKAPLHEQNGVPHHLLSVIDPSVEFTCRDFRDRALPIIQEIVDRGGVPVVVGGTNFYIQALVSPFLLDDMAEEMXGXTLRDHI

SEQ ID NO: 73 - protein, 237 aa, Zea mays subsp. mays
  misc_feature (5)..(5): Xaa can be any naturally occurring amino acid
IHALXSPFLLDDMAEEMQGCTLRDHIDDGIGLTDEDEGNGFERLKEIDPMAAQRIHPNDHRKIKRYLELYATTGALPSDLFQGEAAKKWGRPSNSRLYCCFLWVDADLQVLDSYVNKRVDCMMDGGLLDEVCSIYDADAVYTQGLRQAIGVREFDEFFRAYLARKESGEGSCASLLGMHDDQLKSLLDEAVSQLKANTRRLVRRQRRRLHRLSKDFGWNLHRVDATEAFFCATDDSW

SEQ ID NO: 74 - protein, 221 aa, Zea mays subsp. mays
  misc_feature (213)..(213): Xaa can be any naturally occurring amino acid
AKKWGRPSNSRLYCCFLWVDADLQVLDSYVNKRVDCMMDGGLLDEVCSIYDADAVYTQGLRQAIGVREFDEFFRAYLARKESGEGSCASLLGMHDDQLKSLLDEAVSQLKANTRRLVRRQRRRLHRLSKDFGWNLHRVDATEAFFCATDDSWQKKVVEPCVDVVRRFLSDDSTVLPSTSASDPSSRELWTQYVCEACDNRVLRGAHEWEQHRXGRGRGSEC

SEQ ID NO: 75 - protein, 162 aa, Zea mays subsp. mays
MAHPSAAAVSSTALAANPSSGASEEGGARSPPSPSQRGRAKVVIVMGATGAGKSRLAVDLAAHFAGVEVVSADSMQLYRGLDVLTNKAPLHEQNGVPHHLLSVIDPSVEFTCRDFRDRALPIIQEIVDRGGVPVVVGGTNFYIQALVSPFLLDDMAEEMQGC

SEQ ID NO: 76 - protein, 198 aa, Zea mays subsp. mays
  misc_feature (195)..(196): Xaa can be any naturally occurring amino acid
LAAHFAGVEVVSADSMQLYRGLDVLTNKAPLHEQNGVPHHLLSVIDPSVEFTCRDFRDRALPIIQEIVDRGGVPVVVGGTNFYIQALVSPFLLDDMAEEMQGCTLRDHIDDGIGLTDEDEGNGFERLKEIDPMAAQRIHPNDHRKIKRYLELYATTGALPSDLFQGEAAKKWGRPSNSRLYCCFLWVDADLQVLXXYS

SEQ ID NO: 77 - protein, 118 aa, Zea mays subsp. mays
MAHPSAAAVSSTALAANPSSGASEEGGARSPPSPSQRGRAKVVIVMGATGAGKSRLAVDLAAHFAGVEVVSADSMQLYRGLDVLTNKAPLHEQNGVPHHLLSVIDPSVEFTCRDFRDR

SEQ ID NO: 78 - protein, 135 aa, Glycine max
  misc_feature (112)..(112): Xaa can be any naturally occurring amino acid
MISNGVCTLRTCLRFPARPLFREPPRLFSCRQRFLVTASETKKKEKVIVISGPTGSGKSRLALELAKRLNGEIVSADSVQVYRGLDVGSAKPSPNERKEVPHHLVDILHPSXFFEDARQATGCILDNGRVPIVVG

SEQ ID NO: 79 - protein, 194 aa, Glycine max
  misc_feature (112)..(112): Xaa can be any naturally occurring amino acid
  misc_feature (157)..(157): Xaa can be any naturally occurring amino acid
  misc_feature (168)..(168): Xaa can be any naturally occurring amino acid
  misc_feature (179)..(179): Xaa can be any naturally occurring amino acid
MISNGVCTLRTCLRFPARPLFREPPRLFSCRQRFLVTASETKKKEKVIVISGPTGSGKSRLALELAKRLNGEIVSADSVQVYRGLDVGSAKPSPNERKEVPHHLVDILHPSXFFEDARQATGCILDNGRVPIVVGGTGLYLRWFIYGKPDVPKASPXIVSEAYQELAXLQRNDDWDTAXQLVVKAGDPKAQFLA

SEQ ID NO: 80 - protein, 150 aa, Triticum aestivum
MPHLAAPASPPPAPNLMSDAREAASSSPPSERGRRKAVVVVMGATGAGKSRLAVDLAGHFAGVEVVSADSMQVYRGLDVLTNKVSLDEQNGVPHHLLSIVDPSVEFTCRHFRDHALPIIEDILDRGGLPVVVGGTNFYIQALVSPCLFDM

SEQ ID NO: 81 - protein, 180 aa, Glycine max
  misc_feature (11)..(11): Xaa can be any naturally occurring amino acid
  misc_feature (61)..(61): Xaa can be any naturally occurring amino acid
  misc_feature (69)..(69): Xaa can be any naturally occurring amino acid
  misc_feature (76)..(77): Xaa can be any naturally occurring amino acid
  misc_feature (83)..(83): Xaa can be any naturally occurring amino acid
  misc_feature (85)..(85): Xaa can be any naturally occurring amino acid
  misc_feature (96)..(96): Xaa can be any naturally occurring amino acid
  misc_feature (124)..(124): Xaa can be any naturally occurring amino acid
  misc_feature (126)..(126): Xaa can be any naturally occurring amino acid
  misc_feature (131)..(131): Xaa can be any naturally occurring amino acid
  misc_feature (167)..(167): Xaa can be any naturally occurring amino acid
  misc_feature (173)..(173): Xaa can be any naturally occurring amino acid
KEKVIVISGPXGSGKSRLALELAKRLNGEIVSADSVQVYRGLDVGSAKPSPNERKEVPHHXVDILHPSXFFEDARXXTGCILXNXRVPIVVGGTGXYLRWFIYGKPDVPKASPEIVSEAYQELXEXQRNDXWDTAVQLVVKAGDPKAQFLAVNDWYRLRRSLEIIKXSGSPPXAFQVPYD

SEQ ID NO: 82 - protein, 110 aa, Triticum aestivum
MPHLAAPASPPPAPNLMSDAREAASSSPPSERGRRKAVVVVMGATGAGKSRLAVDLARHFAGVEVVSADSMQVYRGLDVLTNKVSLDEQNGVPHHLLSIVDPSVEFTCLL

SEQ ID NO: 83 - protein, 120 aa, Arabidopsis thaliana
  misc_feature (30)..(31): Xaa can be any naturally occurring amino acid
  misc_feature (38)..(38): Xaa can be any naturally occurring amino acid
  misc_feature (48)..(48): Xaa can be any naturally occurring amino acid
MVIGSGVFLTRTCYLRLQPPSLVLRRRFCXXTTACSVXLNGNKKKKSXKEKVIVISGPTGAGKSRLAMELAKRLNGEIISADSVQVYKGLDVGSAKPSDSDRKVVPHHLIDILHPSQDYS

SEQ ID NO: 84 - protein, 158 aa, Triticum aestivum
MPHLAAPASPPPAPNLMSDAREAASSSPPSERGRRKAVVVVMGATGAGKSRLAVDLAGHFAGVEVVSADSMQVYRGLDVLTNKVSLDEQNGVPHHLLSIVDPSVEFTCRHFRDHALPIIEDILDRGGLPVVVGGTNFYIQALVSPFLFEDMSEDMQGC

SEQ ID NO: 85 - protein, 148 aa, Triticum aestivum
MPHLAAPASPPPAPNLMSDAREAASSSPPSERGRRKAVVVVMGATGAGKSRLAVDLAGHFAGVEVVSADSMQVYRGLDVLTNKVSLDEQNGVPHHLLSIVDPSVEFTCRHFRDHALPIIEDILDRGGLPVVGGTNFYIQALVSPYLFE

SEQ ID NO: 86 - protein, 152 aa, Brassica napus
AVSDITSRKKLPIIAGGSNTLVHALLAERFDPKIDPFGSSSISRELRYNCCFIWVDVSETVLFEYLLKRVDDMMGSGMFEELSRFYDPVKASTTRVGIRKAIGVPEFDGYFKMYPPEKEGEWDSGRRAAYDKVVEEIKENTLRLAKRQVVKI

SEQ ID NO: 87 - protein, 57 aa, Brassica napus
TRHILGATCRGESVRFVDLTSRFLAEIINSDKMKVHEELHINTNQVTMLERRTPHHI

SEQ ID NO: 88 - protein, 139 aa, Zea mays subsp. mays
MAHPSAAAVSSTALAANPSSGASEEGGARSPPSPSQRGRAKVVIVMGATGAGKSRLAVDLAAHFAGVEVVSADSMQLYRGLDVLTNKAPLHEQNGVPHHLLSVIDPSVEFTCRDFRDRALPIIQEIVDRGGLPVVVGGT

SEQ ID NO: 89 - protein, 143 aa, Glycine max
MHLFKQTILVFFLINFLQIYIILNTLMAPLSLAEKKKVLFIMGATGTGKTKLSINLGTQFPSEVINSDKIQVYKGLDIITNKVPESERNGIPHHLLGIIDDPDYDFTVDDFCKHVLIALDLIIENGHLPIIVGGSNTYLATLL

SEQ ID NO: 90 - protein, 177 aa, Glycine max
  misc_feature (156)..(156): Xaa can be any naturally occurring amino acid
  misc_feature (169)..(169): Xaa can be any naturally occurring amino acid
  misc_feature (173)..(173): Xaa can be any naturally occurring amino acid
MHLFKQTILVFFLINFLQIYIILNTLMAPLSLAEKKKVLFIMGATGTGKTKLSINLGTQFPSEVINSDKIQVYKGLDIITNKVPESERNGIPHHLLGIIDDPDYDFTVDDFCKHVLIALDLIIENGHLPIIVGGSNTYLATLLEDPNIAFRSKYDXCFIWVDVSLPVLXQYLXKRVD

SEQ ID NO: 91 - protein, 66 aa, Brassica napus
  misc_feature (10)..(10): Xaa can be any naturally occurring amino acid
  misc_feature (20)..(20): Xaa can be any naturally occurring amino acid
  misc_feature (26)..(26): Xaa can be any naturally occurring amino acid
LTVDPVTRLXAEIINSDKMXSLQEIXVTKNQTTMREGRGISHHLLCQLFQERRRIKYGEVCDAPAL

SEQ ID NO: 92 - protein, 123 aa, Arabidopsis thaliana
  misc_feature (31)..(31): Xaa can be any naturally occurring amino acid
MVIGSGVFLTRTCYLRLQPPSLVLRRRFCAXTTACSVPLNGNKKKKSEKEKVIVISGPTGAGKSRLAMELAKRLNGEIISADSVQVYKGLDVGSAKPSDSDRKVVPHHLIDILHPSQDYSVGQ

SEQ ID NO: 93 - protein, 87 aa, Arabidopsis thaliana
  misc_feature (30)..(31): Xaa can be any naturally occurring amino acid
  misc_feature (48)..(48): Xaa can be any naturally occurring amino acid
MVIGSGVFLTRTCYLRLQPPSLVLRRRFCXXTTACSVPLNGNKKKKSXKEKVIVISGPTGAGKSRLAMELAKRLNGEIISADSVQVY

SEQ ID NO: 94 - protein, 71 aa, Arabidopsis thaliana
  misc_feature (34)..(34): Xaa can be any naturally occurring amino acid
MKFSISSLKQVQPILCFKNKLSKVNVNSFLHPKXKVIFVMEATGSGKSRLAIDLATRFQGEIINSDKIQLY

SEQ ID NO: 95 - protein, 121 aa, Arabidopsis thaliana
  misc_feature (31)..(31): Xaa can be any naturally occurring amino acid
  misc_feature (63)..(63): Xaa can be any naturally occurring amino acid
  misc_feature (89)..(89): Xaa can be any naturally occurring amino acid
  misc_feature (105)..(105): Xaa can be any naturally occurring amino acid
MVIGSGVFLTRTCYLRLQPPSLVLRRRFCAXTTACSVPLNGNKKKKSEKEKVIVISGPTGAGXSRLAMELAKRLNGEIISADSVQVYKXLDVGSAKPSDSDRKVXPHHLIDILHPSQDTLW

SEQ ID NO: 96 - protein, 218 aa, Arabidopsis thaliana
  misc_feature (2)..(2): Xaa can be any naturally occurring amino acid
  misc_feature (4)..(4): Xaa can be any naturally occurring amino acid
  misc_feature (201)..(201): Xaa can be any naturally occurring amino acid
FXSXAGNLTATQYSRLASQAISKLSANNKLPIVAGGSKSYIEALVNHSSGFLLNNYDCCFIWVDVSLPVLNSFVSKRVDRMMEAGLLEEVREVFNPKANYSVGIRRAIGVPELHEYLRNESLVDRATKSKMLDVAVKNIKKNTEILACRQLKKIQRLHKKWKMSMHRVDATEVFLKRNVEEQDEAWENLVARPSERIVDKXFYNNNNQLKNDDVEHCL

SEQ ID NO: 97 - protein, 208 aa, Arabidopsis thaliana
KFSISSLKQVQPILCFKNKLSKVNVNSFLHPKEKVIFVMEATGSGKSRLAIDLATRFQGEIINSDKIQLYKGLDVLTNKVTPKECRGVPHHLLGVFDSEAGNLTATQYSRLASQAISKLSANNKLPIVAGGSKSYIEALVNHSSGFLLNNYDCCFIWVDVSLPVLNSFVSKRVDRMMEAGLLEEVREVFNPKANYSVGIRRAIGVPEL

SEQ ID NO: 98 - protein, 157 aa, Arabidopsis thaliana
  misc_feature (5)..(5): Xaa can be any naturally occurring amino acid
  misc_feature (8)..(8): Xaa can be any naturally occurring amino acid
  misc_feature (19)..(19): Xaa can be any naturally occurring amino acid
SCLIXSDXLYECCFIWVDXSETVLYEYLLRRVDEMMDSGMFEELSRFYDPVKSGLETRFGIRKAIGVPEFDGYFKEYPPEKKMIKWDALRKAAYDKAVDDIKRNTWTLAKRQVKKIEMLKDAGWEIERVDATASFKAVMMKSSSEKKWREIWEEQVL

SEQ ID NO: 99 - protein, 114 aa, Arabidopsis thaliana
  misc_feature (31)..(31): Xaa can be any naturally occurring amino acid
MVIGSGVFLTRTCYLRLQPPSLVLRRRFCAXTTACSVPLNGNKKKKSEKEKVIVISGPTGAGKSRLAMELAKRLNGEIISADSVQVYKGLDVGSAKPSDSDRKVVPHHLIDILH

SEQ ID NO: 100 - protein, 228 aa, Glycine max
SDAKCGAATTARSGVAYVTELPHHLLGTVDPYINFSANDFCRYATLAIDSIVEKNGLPIIAGGSNSYLDALVNHYPEFRLRYQCCFLWVDVSLPVLHSSLQARVDRMIEAGQVNEVRQFFDPSVTDYTKGIRRAIGVPEFDDFLRAEANGRVDERTKQRLLEAAIARLKINNCTLANRQIQKIHRLHAFWKRNMHRLDATEVFRGSRDAWRDHVLAKTLIILHKFLYG

SEQ ID NO: 101 - protein, 465 aa, Glycine max
  misc_feature (112)..(112): Xaa can be any naturally occurring amino acid
MISNGVCTLRTCLRFPARPLFREPPRLFSCRQRFLVTASETKKKEKVIVISGPTGSGKSRLALELAKRLNGEIVSADSVQVYRGLDVGSAKPSPNERKEVPHHLVDILHPSXFFEDARQATGCILDNGRVPIVVGGTGLYLRWFIYGKPDVPKASPEIVSEAYQELAELQRNDDWDTAVQLVVKAGDPKAQFLAVNDWYRLRRSLEIIKSSGSPPSAFQVPYDSFREQGEYGVADGSELSDMNTYGDAMEKTNSSELDYEFMCFFLSSHRLDLYKSIDYRCEDMLLGRDGILSEAQWLLDTGLHPNSNSATKAIGYRQAMEYLQRCREQGGHSSVEEFYKFLFEFQKASRNFAKRQLTWFRNENIYQWLDASKPLETILDFIHGAYHDWNGSILVPEDLRMSRDISNHRQAAQLKAYRTRNRHFVNGEDCTHILNWIRKTQRLKRKFYSYCRFLITSFCLFDRIL

SEQ ID NO: 102 - protein, 95 aa, Glycine max
LVLLVAGQKWGQVDNLRYDCCFICVDASLPVLDRYVEQRVDCVMHEGLLNEVYDIYNLNAVYTRGLRQAIGVREFEPLLRTCVVKDMHALLSSSP

SEQ ID NO: 103 - protein, 111 aa, Glycine max
MAATESTVTSNPSNRERPKPKPKLLVITGPTASGKSKLAVDLASHFPVELINADSMQVYRGLDVLTNKLPLSHQNGVPHHLLGTVSPNVEFTAKAFRDSAIPIIDDIFSSL

SEQ ID NO: 104 - protein, 202 aa, Glycine max
RERPKPKPKLLVITGRTASGKSKLADDLASHFPVELINADSMQVYRGLDVLTNKLPLSHQNGVPHHLLGTVSPNVEFTAKAFRDSAIPIIDDILARRVGGLIGGGTNYYIQALVSPFLLDDSAEDMDESCLGDPTGSGNNFIGENDCSNNSYDLLKDIDPVAANRIHPNNHRKINQYINLYNRTGVLSSNIFQERQQKKGSR

SEQ ID NO: 105 - protein, 181 aa, Gossypium hirsutum
GLVDRCCFICIDAALPVLDQYVEHRVDCMIDAGLLDEVYDIYNPNANYTLGLRQAIGVREFENFLQAYFSDSLDDETSDSSDGTLLKLSTRIDDKLFKENTRGILISSCDNPQKVMLEEAIDKVKANTRRLVRRQKRRVNQLQTLFGWNISYVDATEYISKKSDECWAVQVVGSAVKNDRS

SEQ ID NO: 106 - protein, 122 aa, Hordeum vulgare
MCCEMRPGFGFGFGSARRGIWGTWPALCSRNQQRFASSLDVMAATMPAPNQARKRSKVIVISGPTGAGKSRLALEVARRLGGEIISADSVQVYRSLDVGSAKPSASEMSMVPHHLIDIMHAC

SEQ ID NO: 107 - protein, 226 aa, Hordeum vulgare
  misc_feature (57)..(57): Xaa can be any naturally occurring amino acid
GTRELHVLDNYVNERVDCMINAGLLDEVRNIYNPGAVYTQGLRQAIGVREFDEFFHXYFTKKEPNNEMKAGMLDLHDDKLKNLLDEAVSQLKANTRRLVRRQRRRLHRLNKDFGWHLHHIDATEAFQCTTGDSWHVKVIKPCVDTVRRFLSNDTSLASKDCSNDGGGTRLASRELWTQYVCEACDNRILRGAHEWEQHKQGRGHRKRTQRLKRKSKMKSTSSEAEV

SEQ ID NO: 108 - protein, 289 aa, Hordeum vulgare
MGAAVMEQRRGGKPKVVFVLGATATGKSKLAISLAARFGGEVINSDKIQVYAGLPVITNKVTDEECAGVPHHLLGSVPCPDADFTVDDFCREAADAIKRVLSHGGLPVVAGGSNRYVEALVDGDGGAFRSSHDCLFVWLDAAPEVLRRSTAVRVDDMVRRGLVEEARAAFDPDASYTRGVRRAIGLPEMDAYLRRASDGDDEAMLGRAVEEIKVNTFGLVLEQVEKIRRLSTLERWDVRRVDCTEVLARMVDGEGVQELWRKVVWEPVEDMVRTFVIAEKSCGKISLLA

SEQ ID NO: 109 - protein, 124 aa, Aspergillus ochraceus
MRQFFRYLSPIRPLSIMEPLLTVVGATGTGKSKLAVDLASRFNGEIINGDAMQMYRGLPIITNQIPVEERNGIPHHLIDCIGLGEEPWRVGLFKNECLRLIRDIHSRGKIPILVGGTHYYTQAV

SEQ ID NO: 110 - protein, 117 aa, Brassica napus
MTELNLLPKISDHFTTTSTSPSFSSHSHFPFSVPTNDQSRPQNLKDKIVVILGATGAGKSRLSVDIATRLPSEIINSDKIQLYKGLEITTNQITIPDRRGVPHHLLGYLRSEDGELT

SEQ ID NO: 111 - protein, 152 aa, Zea mays
  misc_feature (10)..(10): Xaa can be any naturally occurring amino acid
MSLYLAPRPXAATTTTTTLPRQLLPAPSIDLRRLERRGMALPLPPAPAPPPPLVSANNRHAGAKHKAVVVMGATGTGKSRLAVDLALRFGGEVINSDKIQLHAGLDVTTNKVTEQDRAGVPHHLLGVARPDEEFTAADFRREATRAARAITA

SEQ ID NO: 112 - protein, 262 aa, Zea mays
MAHPSSAAAVSSTAPAANPSYGAREEGGARSPPSPSPSPSQRGRAKVVIVMGATGAGKSRLAVDLAAHFAGVEVVSADSMQLYRGLDVLTNKAPLHEQNGVPHHLLSVIDPSVEFTCRDFRDRALPIIQEIVDRGGLPVVVGGTNFYIQALVSPFLLDDMAEEMQGCTLRDHIDDGIGLTDEDEGNGFERLKEIDPVAAQRIHPNDHRKIKRYLELYATTGALPSDLFQGEAAKKWGRPSNSRLDCCFLWVDADLQVLDSYV

SEQ ID NO: 113 - protein, 172 aa, Lotus corniculatus var. japonicus
MSISMLMCRLRQPLINVPCSGKKMSMRQIQKEKVVLVMGATGTGKSKLSIDLATCFPSEIINSDKIQIYDGLDIVTNKISKEEQRGIPHHLLGTQNPNTDFTAGDFRDCSTAAIDAITSRDHLPIIAGGSNSYLEALIDDDDYKFRSRYDFCCLWVDVAMPVLDSYVAARVD

SEQ ID NO: 114 - protein, 122 aa, Medicago truncatula
  misc_feature (113)..(113): Xaa can be any naturally occurring amino acid
MINNGVHSLRTCLRLPEHPIFRATPLSYNFRRRFFVTASLTEKKKEKVIVISGPTGSGKSRLAMELAKSINGEIVSADSVQVYKGLDVGSAKPSLNDRKEVPHHLVDILHPSXDYSVGQFFE

SEQ ID NO: 115 - protein, 467 aa, Medicago truncatula
MATENTATINPTHPKQPKVVVITGPTGSGKSKLAVDLASHFPIEVINADSMQVYRGLDILTNKLPFSEQNGVVHHLLGCVNPNLEFTAKTFRDSAIPIIDEILSRNHLPVIVGGTNYYIQALVSQFLLDDSTDDLSESYLGDSPGITGFDTNFVAENDSSSNSYDLLKDIDPVAANRIHPNNHRKINQYISLYSRTGVLPSKVFQGQAAEKWGQADNLRYACCFISVDASLPILDRYVEQRVDDMMDADYTRGLRQAIGVREFEDLLRTSVFKNINQREGELIDGSSLENSEPLFDGNLMAWLRSFSDTKSTTLLEDAIEKVKVNTRRLVRRQKRMLSRLETLFGWDIHYVDSTESILSKSNDIWNRQVVESATKIVTTFVSENGSLLSTFGMSNGTGTKIIQRDLWTQYTCKACNDRVLRGLHEWEQHIRGRGHRKRISSLKSKAKGLSFVEKKCEPSEHECSDIL

SEQ ID NO: 116 - protein, 524 aa, Neurospora crassa
MRWTIPVFSQAIRSVFRTATMADPLVVIYGSTGTGKSDLAVELATRFNGEIINVDAMQMYRGLPIITNQLTPEEQRGIPHYLLGNIGLDEEPWSVTSWKREATRIISDIRSRGKLPIVVGGTSYYLDGLLFDEKLNQRPAAKATRDELASQHPILRESAEVMLAKNQRPAAKATRDELASQHPILRESAEVMLAKLQEVDPVMAERWHPKDIRKIRNSLEIYLSTGRRASDIYAEQRARKEAKRAEQPPSPWNLLLFWLYAKPDVLNERLDKRVDKMVANGLLDETSSVYDYLQRRLAAGDTVDRTKGIWQSIGFRQFESYLSAVKSTETDTPQAALEKLKQQGIEDTKTATRQYAKYQIRWIARKTIAAPGRVLSNFYLLDSSNISHWHSEVAEKGSSLLAKHLAHQPLPRPEDFSWKGATDPRQYETCEVCGKEFRIEPEDFSWKGATDPRQYETCEVCGKEFRIEEQWQKHLKSKKHQKAVKWARRQDEDEVPDFYTQRIFPTENQFSNLHFSQGSEDRRM

SEQ ID NO: 117 - protein, 737 aa, Neurospora crassa
MMGRIGRVGRDNAVEGHLAHDQEDEQGQAGPHQLLVEGDLGLGLLNLGEERHEGLDEIEEPYCMAGGRIKQGKEVEGRVVVEEEEELAIKRSVLEVGWKCGKWKLAEGHGRRKAVRRREICPKSRPSVMCPIWRVPVAGLVLPKSNANCIDGQPGQPSVPAGGCSLSPRPCRNVKSSFQLQATSGPLSTIEGRHLDPSTVQPPLVETGIQIVGEALDSRRDSRSGRQGLGVSVWMPFISLIDNNPCVKGTFHLRLKAIRSVFRTATMADPLVVIYGSTGTGKSDLAVELATRFNGEIINVDAMQMYRGLPIITNQLTPEEQRGIPHYLLGNIGLDEEPWSVTSWKREATRIISDIRSRGKLPIVVGGTSYYLDGLLFDEKLVESDPATTEESETAAAKATRDELASQHPILRESAEVMLAKLQEVDPVMAERWHPKDIRKIRNSLEIYLSTGRRASDIYAEQRARKEAKRAEQPPSPWNLLLFWLYAKPDVLNERLDKRVDKMVANGLLDETSSVYDYLQRRLAAGDTVDRTKGIWQSIGFRQFESYLSAVKSTETDTPQAALEKLKQQGIEDTKTATRQYAKYQIRWIARKTIAALQEENLLSNFYLLDSSNISHWHSEVAEKGSSLLAKHLAHQPLPRPEDLSDTAREVLAEQLERSNRPETICNKTCEVCGKEFRIEEQWQKHLKSKKHQKAVKWARRQAEGWPTRGVAKGDKVEEGTDDDVDADDSDGQVPKP

SEQ ID NO: 118 - protein, 1022 aa, Neurospora crassa
MADPLVVIYGSTGTGKSDLAVELATRFNGEIINVDAMQMYRGLPIITNQLTPEEQRGIPHYLLGNIGLDEEPWSVTSWKREATRIISDIRSRGKLPIVVGGTSYYLDGLLFDEKLVESDPATTEESETAAAKATRDELASQHPILRESAEVMLAKLQEVDPVMAERWHPKDIRKIRNSLEIYLSTGRRASDIYAEQRARKEAKRAEQPPSPWNLLLFWLYAKPDVLNERLDKRVDKMVANGLLDETSSVYDYLQRRLAAGDTVDRTKGIWQSIGFRQFESYLSAVKSTETDTPQAALEKLKQQGIEDTKTATRQYAKYQIRWIARKTIAALQEENLLSNFYLLDSSNISHWHSEVAEKGSSLLAKHLAHQPLPRPEDLSDTAREVLAEQLERSNRPETICNKTCEVCGKEFRIEEQWQKHLKSKKHQKAVKWARRQAEGWPTRGVAKGDKVEEGTDDDVDADDSDGQWRAMSNDRSWFVLTKEDARGLQEYGLLNLNHEIGYHELHKGCFLSHNDLSHALRRSPAKPSDMLKIPMIIISREALIWLGFSNKMADQLWQQWLYLHSNRRPGIFEFRDVILTYFRLPDVAGGIPTLNKFNDDDNEWRRVLHAHGLSQQFVNMIMDPCFRTQRLTESCNYWIEDTLRQRWDLLHQSKWNIDEPISLLAHKGRPDKDEDEVPDFYTAKDLPYREPVLESTFLAGLRGPPDAPPCACTVRKDSERRTTQDHLILYKVVTGTQLKNIRVSSSGNLGPVGLSNIDSLVEVSREPEREPFLYNNVTGDGDPQDRVASVMPRRRAHKRADLVFFTCNPEHALAKYKWAVHRLDKRVGAVDAAKFAGGADVQILEIRISMDEMEYLRRAMLAYHIPYSSASNMVAFLMWQEMVFFSRLKELARSKFPFIEAIFWRVWTKLQPEIQEARRSAGPTLRAIQNDQWFVLCFSAVRRRGCWNYVSMKLAEIVEKGTVTSSKPTTTAPPPTSTSNKNIPTSASSSAPLSTAANNGPAPDEDFMSANIPYTREEYLVS

SEQ ID NO: 119 - protein, 915 aa, Neurospora crassa
MADPLVVIYGSTGTGKSDLAVELATRFNGEIINVDAMQMYRGLPIITNQLTPEEQRGIPHYLLGNIGLDEEPWSRGKLPIVVGGTSYYLDGLLFDEKLVESDPATTEESETAAAKATRDELASQHPILRESAEVMLAKLQEVDPVMAERWHPKDIRKIRNSLEIYLSTGRRASDIYAEQRARKEAKRAEQPPSPWNLLLFWLYAKPDVLNERLDKRVDKMVANGLLDETSSVYDYLQRRLAAGDTVDRTKGIWQSIGFRQFESYLSAVKSTETDTPQAALEKLKQQGIEDTKTATRQYAKYQIRWIARKTIAALQEENLLSNFYLLDSSNISHWHSEVAEKGSSLLAKHLAHQPLPRPEDLSDTAREVLAEQLERSNRPETICNKTCEWRAMSNDRSWFVLTKEDARGLQERPGIFEFRDVILTYFRLPDVAGGIPTLNKFNDDDNEWRRVLHAHGLSQQFVNMIMDPCFRTQRLTESCNYWIEDTLRQHEPISLLAHKGRPDKDEDEVPDFYTAKDLPYREPVLESTFLAGLRGPPDAPPCACTVRKDSERRTTQDHLILYKVVTGTQLKNIRVSSSGNLGPVGLSNIDSLVEVSREPEREPFLYNNVTGDGDPQDRVASVMPRRRAHKRADLVFFTCNPEHALAKYKWAVHRLDKRVGAVDAAKFAGGADVQILEIRISMDEMEYLRRAMLAYHIPYSSASNMVAFLMWQEMVFFSRLKELARSKFPFIEAIFWRLAEIVEKGTVTSSKPTTTAPPPTSTSNKNIPTSASSSAPLSTAANNGPAPDEDFMSANIPYTREEWFLTNVCYFETYKLISEEITTQTDEENIYDLEDTPADVGAEAEGDDTSLNRKYLKLFKVAFQDEKLSSVEATSSWFFFYCPDSSSGGEEEGATKSDNQSPRDGDEDGDLNTSR

SEQ ID NO: 120 - protein, 352 aa, Oryza sativa
  misc_feature (129)..(129): Xaa can be any naturally occurring amino acid
PRVRIDPSVEFTCRDFRDHAVPIIEGILDRGGLPVIVGGTNFYIQALVSPFLFDDMAQDIEGLTLNDHLDEIGLDNDDEAGLYEHLKKIDPVAAQRIHPNNHRKIKRYLELYESTGALPSDLFQGQATXDADLHVLDRYVNERVDCMIDDGLLDEVCNIYDREATYTQGLRQAIGVREFDEFFRFYFARKETGEIKMDSCTTMAGLHDDNLKGLLDEAVSQLKANTRRLVRRQRRRLHRLNKYFEWNLRHIDATEAFYGATADSWNMKVVKPCVDIVRDFLSDDTILASRDGSSVTGSPRMSSRELWTQYVCEACDNRVLRGTHEWEQHKQGRCHRKRVQRLKQKASTVISL

SEQ ID NO: 121 - protein, 222 aa, Oryza sativa
MLGNKLVVIIGATGTGKTRLSIEIAKAIGGEVVNADKMQIYDGLDITTNKVSLQDRCGISHHLIASIPRNAGDFPVSFFRSAAKTTINCIARRGHTPIVVGGSNSLIHGLLVDNFDSSIVDPFGQLEVSYRPTPRSQCCFLWVHVNEVILNEYLKHRVDDMVDAGLVEEIEEYFDTLSVNGHVPYVGLGKTIGVPELSEYFTGRVSCSDALSMMKTNTQILA

SEQ ID NO: 122 - protein, 419 aa, Oryza sativa
MAHLAASAAPLPSADPDAGEESSHSPPPPEKGLRKVVVVMGATGAGKSRLAVDLASHFAGVEVVSADSMQVYGGLDVLTNKVPLHEQKGVPHHLLSVIDPSVEFTCRDFRDHAVPIIEGILDRGGLPVIVGGTNFYIQALVSPFLFDDMAQDIEGLTLNDHLDEIGLDNDDEAGLYEHLKKIDPVAAQRIHPNNHRKIKRYLELYESTDADLHVLDRYVNERVDCMIDDGLLDEVCNIYDREATYTQGLRQAIGVREFDEFFRFYFARKETGLHDDNLKGLLDEAVSQLKANTRRLVRRQRRRLHRLNKYFEWNLRHIDATEAFYGATADSWNMKVVKPCVDIVRDFLSDDTILASRDGSSVTGSPRMSSRELWTQYVCEACDNRVLRGTHEWEQHKQGRCHRKRVQRLKQKASTVISL

SEQ ID NO: 123 - protein, 363 aa, Oryza sativa
MAAAAVAGVGRDGSFASQKRPRRVSVRMERSRVGDGCCCSCSGRGGVASTTAVRPSTGMVVIVGATGTGKTKLSIDAAQELAGEVVNADKIQLYDGLDVTTNKVSLADRRGVPHHLLGAIRAEAGELPPSSFRSLAAAAAAGIASRGRVPVVAGGSNSLIHALLADPIDAAPRDPFADADVGYRPALRFPCCLLWVDVDDDVLDEYLDRRVDDMVGEGMVEELEEYFATTSASERASHAGLGKAIGVPELGDYFAGRKSLDAAIDEIKANTRVLAARQVGKIRRMADVWGWPIRRLDATATIRARLSGAGRAAEAAAWERDVRGPGLAAMRQFVGRADFNAAAVDQLAARSRRQCLRGGMVAG

SEQ ID NO: 124 - protein, 328 aa, Oryza sativa
MEHCNGIAAVGRWLSTKPKVIFVLGATATGKSKLAIRLAARFDGEVINSDKIQAHDGFPVITNKVTDEERAGVAHHLLGGVSPDADFTAEDFRREAAAAVARVHAAGRLPVVAGGSNIYVEALVAGGGGAFLAAYDCLFLWTDVAPDLLRWYTAARVDDMVRRGLVGEARAGFDAGADYTRGVRRAIGLPEMHGYLLAEREGGAGAEDDDDLLAGMLEAAVREIKDNTFRLTVSQVAKIRRLSALPGWDVRRVDATAVVARMAEGAPHGETWREVVWEPCEEMVSRFLETPAAAAAVVANGKVDVNVGDAAAGVPEAAAAAVVAAGVV

SEQ ID NO: 125 - protein, 325 aa, Oryza sativa
MEYHVGGVIGQSPKPKVVFVLGATATGKSKLAISIAERFGGEVINSDKIQVHDGFPIITNKVTEEERAGVPHHLLGVLHPDADFTAEDFRREAAAAVARVLAAGRLPVVAGGSNTYVEALVEGGGGAFRAAHDCLFLWTDVAPGLLRWYTAARVDDMVRRGLVGEARAGFVDGAGAADYYTRGVRRAIGIPEMHGYLLAERSGGEAADDGELAAMLDGAVREIKANTYRLAATQVAKIRRLSALDGWDVRRVDATVVVARMAEGAPHRETWEAVVWKPCEEMVGRFLEASAAVDDDDNAAAGSPAALAPMTAACRLRAQLVQLQY

SEQ ID NO: 126 - protein, 357 aa, Oryza sativa
MQAYMAVAAAPAPPASLTLLPRTTTVIRDRERFDAAVPVAPLVLRHGAGVKHKAVVVMGATGTGKSRLAVDLALRFGGEVINSDKMQIHSGLDVVTNKVTEEECAGVPHHLISVARPDDEFTAADFRREAARAAAGAVERGRLPIIAGGSNSYVEELVEGDGRAFRERYECCFLWVDVDLEVLRGFVARRVDEMCRRGLVREVAAAFDPRRTDYSRGIWRAIGVPELDAYLRSRGDGADEEERARMLAAAVAEIKLNTFRLACRQHRKIERLDRMWRARRVDATEVFRRRGHAADDAWQRLVAAPCIDAVRSFLFEDQERSSIAAGKPPLFAAGKATSGNISVFASAAAAMAAAAAI

SEQ ID NO: 127 - protein, 341 aa, Oryza sativa
MEGSRGDKGKVVVVMGATATGKSKLAIDLALRFGGEVINSDKIQVHDGLDVVTNKVTDEERAGVPHHLIGGVPPDADYGVDDFRRDAARAVASVLARGRVPVIAGGSNRYLEALLDGEGGSFRERHELCFLWVDSRAPALHRYVRHRVDRMVEQGLVGEVRGLFRLDDADYSRGIRRSIGVPEMDAYLRQEATGALLTHGDKYKVALLASAVGEIKANTWSLARRQLRKIHRLRGLPGWSLRRLDVTRVLELKVEARSEAECAAAWEADVIAPAAREVGMFLHGGGNVVESGREEQPVVVEKMEVAAVGGAGAAAAAEKWCGRRLLETTAAYHGMEAAAAV

SEQ ID NO: 128 - protein, 455 aa, Oryza sativa
MTSVATRIATLVRAAAAASRPLRLHRRPGGEDTRMVVIVGATGTGKTKLSIDAAKVIGGEVVNADKIQLYDGLDVTTNKVSLADRRGVPHHLLGAIRPEAGELPPSSFRSLAAATAASIAARRLVPVIAGGSNSLIHALLADHFDASAGDPFSPAAAFRHYRPALRFPCCLLWVHVDEALLDEYLDRRVDDMVDAGMVEELREYFATTTAAERAAHSGLGKAIGVPELGDYFAGRKTFSEAIDDIKANTRVLAAAQVSKIRRMSDAWGWPIHRLDASDTVRARLTRAGSAAESASWERDVRGPGLATIRSFLADQSPPPRSEGTNDYLYAMETEPEPPPPPTLPPRLLRLPRMQYCDMVGRICVLFLGEVVIHHIALLLTAALILQSSTFACIIAAVYECQVSWIIASFASGLFCRIAVLDETVKELDIWKLKIVNGFLKITMCLKDWSGYPLGV

SEQ ID NO: 129 - protein, 347 aa, Oryza sativa
MATSLSLAPKPAAVAVAAAAIPRLVPPPSIDMSALSPPPPLVSVSRSMVAKHKAVVVMGATGTGKTRLAVDLALQFGGEVINADKLQLHRGLDVATNKATADERAGVPHHLIGVAHPDEEFTAADFRRAASRAAAAVAARGALPIIAGGSNSYIEELVDGDRRAFRDRYDCCFLWVDVQLPVLHGFVGRRVDDMCGRGMVAEIEAAFDPDRTDYSRGVWRAIGVPELDAYLRSCAAAGGEEERARLLANAIEDIKANTRWLSCRQRAKIVRLDRLWRIRRVDATEAFRRRGGAANEAWERHVAAPSIDTVRSFLHGEFTTAAETTAAPVPPPPFLPMFALAAAGAGV

SEQ ID NO: 130 - protein, 145 aa, Pinus taeda
LDAAIRRMKENTCQLVRKQKQRISGLKTCSGWNLHQLDSTKALETSGCMIYAPSQSLLFFFAESLEHWEMMVVNISMDVVKRFLSGHYGRASLKENVESRGDSMHPEQAQDLWIHSCEACRDQVLQGAHEWEKHKLGHSHRRQVL

SEQ ID NO: 131 - protein, 250 aa, Solanum tuberosum
MISTVGTGGVRICSYLRLPYTVETLLRRRCRLFTSCSASSTKEKVIVISGPTGAGKSKLALELAKRLNGEIISADSVQVYRGLDVGSAKPSFDERKEVVHHLVDILHPSEDYSVGQFFEDARQTTRDILDRGRVPIVAGGTGLYLRWFIYGKPDVPKASREIAAEVDSELASLQNDEEWNAAVQLLVKAGDPGAQSLPANDWYRLRRRLEIVKSTGSPSSAFEVPYDSFREQLVSGPVGAPAVAGWALDV

SEQ ID NO: 132 - protein, 208 aa, Solanum tuberosum
  misc_feature (170)..(170): Xaa can be any naturally occurring amino acid
DVGPTPAFPAKPKLTIDYLPRRFGLDINTVTVQQAYFHYLRGDLYDSDFDLLYTDHDRVSGIINSPKLPSIVGGSNPFIHYMLLNQSNPVQSKLRHRFYFKCVDGLDTDLLQYLGKRIDETMDFDESWFPDWSTGLTVPEEVKEIKENTRYLTEKQMWKIQRVEAMEAYXPTMSPGNSKIPATEIWERQAVLPNLKIVKHFYLQLLLL

SEQ ID NO: 133 - protein, 163 aa, Triticum aestivum
MPHLAAPASPPPAPNLMSDAREAASSSPPSERGRRKAVVVVMGATGAGKSRLAVDLAGHFAGVEVVSADSMQVYRGLDVLTNKVSLDEQNGVPHHLLSIVDPSVEFTCRHFRDHALPIIEDILDRGGLPVVVGGTNFYIQALVSPFLFEDMSEDMQGCLLGTI

SEQ ID NO: 134 - protein, 141 aa, Triticum aestivum
  misc_feature (130)..(130): Xaa can be any naturally occurring amino acid
  misc_feature (137)..(137): Xaa can be any naturally occurring amino acid
MHMRAISAAASGNGKAKVVIVMGATATGKSKLAVDLALRFGGEVVNSDKIQVHDGLPVVTNKATVREQAGVPHHMIGGVHPNADYAAAEFRRDATRAVESVLARGRLLIIGGGSNSYLEALLDGEPGVRXRYDCCFXLWVD

SEQ ID NO: 135 - protein, 468 aa, Zea mays
MAHPSAAAVSSTALAANPSSGASEEGGARSPPSPSQRGRAKVVIVMGATGAGKSRLAVDLAAHFAGVEVVSADSMQLYRGLDVLTNKAPLHEQNGVPHHLLSVIDPSVEFTCRDFRDRALPIIQEIVDRGGVPVVVGGTNFYIQALVSPFLLDDMAEEMQGCTLRDHIDDGIGLTDEDEGNGFERLKEIDPMAAQRIHPNDHRKIKRYLELYATTGALPSDLFQGEAAKKWGRPSNSRLYCCFLWVDADLQVLDSYVNKRVDCMMDGGLLDEVCSIYDADAVYTQGLRQAIGVREFDEFFRAYLARKESGEGSCASLLGMHDDQLKSLLDEAVSQLKANTRRLVRRQRRRLHRLSKDFGWNLHRVDATEAFFCATDDSWQKKVVEPCVDVVRRFLSDDSTVLPSTSASDPSSRELWTQYVCEACDNRVLRGAHEWEQHRQGRGHRKRVQRLKQKSLRPWPSLLPQDRS

SEQ ID NO: 136 - protein, 220 aa, Zea mays
  misc_feature (195)..(195): Xaa can be any naturally occurring amino acid
MAHPSAAAVSSTALAANPSSGASEEGGARSPPSPSQRGRAKVVIVMGATGAGKSRLAVDLAAHFAGVEVVSADSMQLYRGLDVLTNKAPLHEQNGVPHHLLSVIDPSVEFTCRDFRDRALPIIQEIVDRGGLPVVVGGTNFYIQALVSPFLLDDMAEEMQGCTLRDHIDDGIGLTDEDEGNGFERLKEIDPMAAXRIHPNDHRKIKRYLELYATTGGLPS

SEQ ID NO: 137 - protein, 366 aa, Zea mays
  misc_feature (188)..(188): Xaa can be any naturally occurring amino acid
  misc_feature (240)..(240): Xaa can be any naturally occurring amino acid
MAHPSAAAAAVSSTAPAANPSSGAREEGGARSPPSPSPSQRGRAKVVIVMGATGAGKSRLAVDLAAHFAGVEVVSADSMQLYRGLDVLTNKAPLHEQNGVPHHLLSVIDPSVEFTCRDFRDRAVPIIQEIVDRGGLPVVVGGTNFYIQALVSPFLLDDMAEEMQGCTLRDHIDDGLTDEDEGNGFERXEEIDPVAAQRIHSNDHRKIKRYLELYATTGALPSDLFQGEAAKYKLAGNSWXIMSEQKWGRPSNSRLYCCFLWVDADLQVLDSYVNKRVDCMMDGGLLDEVCSIYDADAVYTQGLRQAIGVREFDEFFRAYLARKESGEGSCASLLGMHDDQLKSLLDEAVSQLKANTRRLVRRQVST

SEQ ID NO: 138 - protein, 353 aa, Zea mays
SVIDPSVEFTCRDFRDRALPIIQEIALVSPFLLDDMAEEMQGCTLRDHIDDGLTDEDEGNGFERLKEIDPMAAQRIHPNDHRKIKRYLELYATTGALPSDLFQGEAAKKWGRPSNSRLYCCFPLYCCFLWVDADLQVLDSYVNKRVDCMMDGGLLDEVCSIYDADAVYTQGLRQAIGVREFDEFFRAYLPRKESGEGSCASLLGMHDDQLKSLLDEAVSQLKANTRRLVRRQRRRLHRLSKDFGWNLHRVDATEAFFCATDDSWQKKVVKPCVDVVRRFLSDNSTVLPSTSASDPSSRELWTQYVCEACGNRVLRGAHEWEQHRQGRGHRKRVQRLKQKSLRPWPSLLPQDRS

SEQ ID NO: 139 - protein, 109 aa, Pinus taeda
  misc_feature (36)..(36): Xaa can be any naturally occurring amino acid
  misc_feature (92)..(92): Xaa can be any naturally occurring amino acid
EFEEFFNAFPPSKAKGQEIEKLDKGRHKILLDAAIXRMKENTCQLVRKQKQRISGLKTCSGWNLHQLDSTKALETSGSESLEHWEMMVVNIXMDVVKRFLSECETLKEN

SEQ ID NO: 140 - protein, 172 aa, Pinus taeda
  misc_feature (50)..(50): Xaa can be any naturally occurring amino acid
  misc_feature (113)..(114): Xaa can be any naturally occurring amino acid
  misc_feature (118)..(119): Xaa can be any naturally occurring amino acid
  misc_feature (121)..(122): Xaa can be any naturally occurring amino acid
MEDRLSKSPNAKHKHKVVVIMGATGSGKSRLAIDLAQHFPAEILNADCMXVYEGLDIVTNKVPVEERKGVIHHLLGTVSSKVNFTSSDFRDTAIPIIDSIISRKHLPIIVGGXXSYIXXLXXMDAMKNGDDDLKTSERPFVICSNASVNDLHKRCDNDVQNTSNQFVEDIDL

SEQ ID NO: 141 - protein, 90 aa, Medicago truncatula
  misc_feature (75)..(75): Xaa can be any naturally occurring amino acid
MSISLSMCRLIRQPLTSNVQCSGKKLNMRQIQKENVVLVMGATGTGKSKLSIDLSQLFPVRNQSTSDKIQIYEGXLDIVTNKITLVRTKR

SEQ ID NO: 142 - protein, 209 aa, Lycopersicon esculentum
  misc_feature (188)..(188): Xaa can be any naturally occurring amino acid
  misc_feature (199)..(199): Xaa can be any naturally occurring amino acid
AAISGFRTRWRTLLRRRRLFTSCSASSTKEKVIVISGPTGAGKSKLALELAKRINGEIISADSVQVYRGLDVGSAKPSFDERKEVVHHLVDILHPSEDYSVGQFFEDARQTTRDILDRGRVPIVAGGTGLYLRWFIYGRPDVPKASREIAAEVDSELAKLQNDEDWNAAVQLVVKAGDPRAQSLPGNXWYRLRRRLEMXKSTGSPPSAF

SEQ ID NO: 143 - protein, 57 aa, Pinus taeda
  misc_feature (21)..(22): Xaa can be any naturally occurring amino acid
  misc_feature (48)..(49): Xaa can be any naturally occurring amino acid
  misc_feature (55)..(56): Xaa can be any naturally occurring amino acid
MEENSSGAPCSPAGATDSTHXXVVILGATGAGKSRLAIDLAQHFPAEXXNADSMXXY

SEQ ID NO: 144 - protein, 223 aa, Hordeum vulgare subsp. vulgare
GTRHLAAPASPPPAPNLMSDAREAASSSPPSERGRRKAVVVVMGATGAGKSRLAVDLAGHFTGVEVVSADSMQVYRGLDVLTNKVSLHEQNGVPHHLLSIVDPSVEFTCRDFRDHALPIIEDILDHGGLPVIVGGTNFYIQALVSPFLFEDMSEDMQGCTLSDQLDDIGLATDDVRSGYEHLKEIDPIAAQRIHPNNHRKINRYLELYATTGALPSDLFQEKL

SEQ ID NO: 145 - protein, 152 aa, Triticum aestivum
  misc_feature (97)..(97): Xaa can be any naturally occurring amino acid
  misc_feature (108)..(108): Xaa can be any naturally occurring amino acid
  misc_feature (121)..(121): Xaa can be any naturally occurring amino acid
  misc_feature (129)..(129): Xaa can be any naturally occurring amino acid
  misc_feature (131)..(131): Xaa can be any naturally occurring amino acid
  misc_feature (137)..(137): Xaa can be any naturally occurring amino acid
  misc_feature (143)..(143): Xaa can be any naturally occurring amino acid
  misc_feature (145)..(145): Xaa can be any naturally occurring amino acid
  misc_feature (149)..(149): Xaa can be any naturally occurring amino acid
  misc_feature (152)..(152): Xaa can be any naturally occurring amino acid
MPMISVAPPPALAFPRLTTLTMPPPMIALPDRAHADAPRPPPPLVVRHAAAKHKAVVVMGATGTGKSRLAIDLALRFGGEVINSDKMQVYQGSDVAXNKGPPPGECAXVPNNLFGLRQGTXTRTFSAAXFXEKAQAXRARRRXGXVPVXPGX

SEQ ID NO: 146 - protein, 156 aa, Sorghum bicolor
DIHDDQLKSLLDEAVSQLKANTRRLVRRQRRRLHRLGKDFGWNLHHFDATEAFCCATGDSWQKKVVEPCVDVVKRFLSDDSTVLPSTSASDGVVGSVRGPSRELWTQYVCEACDNRVLRGAHEWEQHKQGRGHRKRVQRLKQKSLRPRPLLSQDCN

SEQ ID NO: 147 - protein, 208 aa, Sorghum bicolor
MADPSAAAAAANPSPGAGEEGAACSPPSPSQRGRGKVVIVMGATGAGKSRLAVDLATHFAGVEVVSADSMQLYRGLDVLTNKVPLHEQNGVPHHLLSVIDPSVEFTCHDFRDHAVPIIQEILDRGGLPVIVGGTNFYIQSLVSPFLFDDMAEEMHDCTLREHIDDDRGLTNDDEGSGYERLKDIDPVAAQRIHPNDHRKIKRYLELYA

SEQ ID NO: 148 - protein, 147 aa, Lycopersicon esculentum
MIGMMNSAQMCKQVRWQNLLQLQNFLQKDKVVVVMGVTGAGKSKLSIDLATQFDGEIINSDKIQVYKGLDIATNKITEEERCGVPHHCLGVIDPYKEFTTKNFCNMASFTVNSITNRGKLPIIVGGSNSFIEAFVHNSNSYNFSTRY

SEQ ID NO: 149 - protein, 220 aa, Medicago truncatula
RHEVATENTATINPTHPKQPKVVVITGPTGSGKSKLAVDLASHFPIEVINADSMQVYRGLDILTNKLPFSEQNGVVHHLLGCVNPNLEFTAKTFRDSAIPIIDEILSRNHLPVIVGGTNYYIQALVSQFLLDDSTDDLSESYLGDSPGITGFDTNFVAENDSSSNSYDLLKDIDPVAANRIHPNNHRKINQYISLYSRTGVLPSKVFQRTGCKGQKWGSS

SEQ ID NO: 150 - protein, 80 aa, Glycine max
MNISTSACACACACKQELPLVSFQKGSLMMESLFHHRNNSNKDKVVVIMGATGAGKTKLAIDVAKHFQPAEIVNSDKMQV

SEQ ID NO: 151 - protein, 159 aa, Gossypium hirsutum
RFGPSYWISVCCCIDHKVPIMLVSFTLCKQTLSLPHKPPGELKSNFFRPRLEKEKVVIIMGATGTGKSRLSIDLATRFPAEIINSDGTRHNDQEDPEEERCGVPHHLLGEISPYTDFTATDFVDMASHAMDSALSGGRVPIIARGWNSYIEALVDDEGL

SEQ ID NO: 152 - protein, 125 aa, Gossypium hirsutum
YFPIEIINADSMQVYQGLDVLTNKVPLREQNGVPHHLLGTVSSDVEFTANKFRDSAIPIISDILSRNHLPVIVGGTNFYIQAVVSSVLLDELVEDFFETYSRDHSGYEHTNSYACLPWRQFHFLL

SEQ ID NO: 153 - protein, 93 aa, Agrobacterium tumefaciens
AGLSIIEELVHLWNQPQLRPILEGIDGYRYAMLFASQNQITPDMLLQLGADMEDKLAHGIAQEYLIHARRQEQEFPSINAVAFEGFEGHPFGM

SEQ ID NO: 154 - protein, 259 aa, Agrobacterium rhizogenes
MRPCRVTPAGFERSEMHMLIYLIYGPTCSGKTDLAVQVARETGWPVIALDRVQCCPQIATGSGRPLESELQSTERIYLDSRPLAEGVIDAEAAHRQLISEVENRRTSPGLILEGGSISLLNCMATDTYWEADFRWHVRRLRLAAPDVFLPRARRRVTEMFAVKDERRSLLQELTDLWKQEALRPILEDIDGYRCAIRFAKEHDIGIRDLLRLDLTRQQALISAIADEYFDHAQWQERDFPDWQEGGNVRLTPRVASNAN

SEQ ID NO: 155 - protein, 243 aa, Agrobacterium tumefaciens
MILHLIYGPTCSGKTDMAIQIAQETGWPVVALDRVQCCPQIATGSGRPLESELQSTRRIYLDSRPLTEGILDAESAHRRLIFEVDWRKSEDGLILEGGSISLLNCMAKSPFWRSGFQWHVKRLRLGDSDAFLTRAKQRVAEMFAIREDRPSLLEELAELWNYPAARPILEDIDGYRCAIRFARKHDLAISQLPNIDAGRHVELIEAIANEYLEHALSQERDFPQWPEDGAGQPVCPVTLTRIR

SEQ ID NO: 156 - protein, 240 aa, Agrobacterium tumefaciens
MDLRLIFGPTCTGKTSTAVALAQQTGLPVLSLDRVQCCPQLSTGSGRPTVEELKGTSRLYLDDRPLVKGIIAAKQAHERLMGEVYNYEAHGGLILEGGSISLLKCMAQSSYWSADFRWHIIRHELADEETFMNVAKARVKQMLRPAAGLSIIQELVDLWKEPRLRPILKEIDGYRYAMLFASQNQITSDMLLQLDADMEDKLIHGIAQEYLIHARRQEQKFPRVNAAAYDGFEGHPFGMY

SEQ ID NO: 157 - protein, 240 aa, Agrobacterium tumefaciens
MDLHLIFGPTCTGKTTTAIALAQQTGLPVLSLDRVQCCPQLSTGSGRPTVEELKGTTRLYLDDRPLVEGIIAAKQAHHRLIEEVYNHEANGGLILEGGSTSLLNCMARNSYWSADFRWHIIRHKLPDQETFMKAAKARVKQMLHPAAGHSIIQELVYLWNEPRLRPILKEIDGYRYAMLFASQNQITADMLLQLDANMEGKLINGIAQEYFIHARQQEQKFPQVNAAAFDGFEGHPFGMY

SEQ ID NO: 158 - protein, 315 aa, Buchnera aphidicola
MNFYKKKPVVIFLMGPTACGKSQLAICLRKYLSIELISVDSALIYRGMDIGTDKPSFSDLYNHPHRLLNIKDPVENYSAAEFQKDVLREIDEIIKLGKIPCLVGGSMFYYNVLLHGLSILPPSNIKLREYLIQKSYEKNYLYKKLKLIDPISASRIHKNDFQRLIRALEIFYLSGKSLTELKKKNNYKLPYNIFQFAIIPPNKEWLNNKIELRIKKMLMLGFQKEVEILFLRGDLHKNLPSIRCIGYRQMWEYLEYKNSYKDMFNKIIHATRKLAKHQLTWLKNWKNINKIEYHSTSTILAKKVLDVLEKNDFSV

SEQ ID NO: 159 - protein, 314 aa, Chlamydia trachomatis
MFKRTVILLAGPTGSGKTAVSLKLAPLVDGEIISVDSMQVYQGMDIGTAKVSLTDRKEVPHHLIDVCHVQESFNAVDFYYHAVQACQDILSRNKVPILVGGTGFYFHTFLSGPPSGPSPDFVLREQLTLEAQERGISALYQELELLDPVYAATITKHDKNKIIRALEIIRKTGSKVSSYAWQSTVNESKEYHCRRWLLSPDPELLRHNILERCDQMLEEGLLDEVQALLAAGIKGNSSASRAIGYREWIEFLDLGSPPDLFEITKQKFITNTWRYTKKQRTWFKRYSLFRELRPMGMTLDDMAKKIAQDYFLCG

SEQ ID NO: 160 - protein, 236 aa, Agrobacterium vitis
MEAHLIFGPTSTGKTSVAIALAKRTGFPVIVLDRIQCYSQLSVGGGRPSAAEFQGTRRIYLIEGSLDEGVISAERAHECLVAAVEAHKPEGGVILEGGSISLFKRMAQSSYWNCGFTWHVTRLHLGGEEIFLAAAKKRINQMMQPDEQGNSFLGELVSVWKTTALRATLEGICGYRYAIEFAGKQGLEMDALTSLNRRQLEQLVHGMAHEYLCYARQQEQELPLPSLAGGEGPPFQ

SEQ ID NO: 161 - protein, 255 aa, Rhodococcus fascians
MKESTMAQTQARFDRVRWEPGVYAIVGATGIGKSAEASKLALSHSAPIVVADRIQCYSDLLVTSGRAFDAKVEGLNRVWLDNRTIHQGNFDPDEAFDRLIKVLTSYVDRGEAVVMEGGSISLILRFAQTISNLPFPAVVNVMPIPDRQHYFAQQCARARQMLRGDSTGRNLLTELAEAWVLGDQHNFIASVAGLDCVLDWCATHSVTPEELANRDLTTEVLDELAASMGGRYVEHGVLQQEIFLRTFGAPGVTAR

SEQ ID NO: 162 - protein, 243 aa, Agrobacterium rhizogenes
MLLYLIYGPTCSGKTDIAIQIAQKTGWPVVALDRVQCCPQIATGSGRPLPSELQSTRRIYLDSRRLTKGIIDAEGAHRRLILEVDWQESEEGLILEGGSVSLLNCMAKSPYWKSGFQWHVKRLRLGDSDAFLARAKQRVTEMFAIREDRPSLLEELAELWNYPATRPILEDIDGYRCAIRFARKHDLAINQLPDIDAERQQDLIEAIAKEYLEHAIMQERDFPQWPEDGARQPVGPATLMRIQ

SEQ ID NO: 163 - protein, 239 aa, Agrobacterium tumefaciens
MDLRLIFGPTCTGKTSTAIALAQQTGLPVLSLDRVQCCPQLSTGSGRPTVEELKGTTRLYLDDRPLVKGIITAKQAHERLIAEVHNHEAKGGLILEGGSISLLRCMAQSRYWNADFRWHIIRNELADEESFMSVAKTRVKQMLRPSAGLSIIQELVQLWREPRLRPILEGIDGYRYALLFATQNQITPDMLLQLDADMENKLIHGIAQEFLIHARRQEQKFPLVGATAVEAFEGPPFRM

SEQ ID NO: 164 - protein, 240 aa, Agrobacterium vitis; identical to SEQ ID NO: 19

SEQ ID NO: 165 - protein, 238 aa, Ralstonia solanacearum
MPIRLYLIWGATTTGKTAQSVALARATGAPVISLDRVQCCHELAVGSGRPLPSELLGTRREYLCDRSVSSGVIPAADANQLLFDKVVRYSAHERALILEGGSVSLINAMIRDARWSALGEWALRRIVLPGRAVFIAQAIKRVRDMLEPPPGHASILDELEGLWAHPGNHAVLEDVDGYRQIIRYARASQVPIDRITSIDRSTMATLVERIAQEYWEHALWQEQEFLGIPATWRRADDA

SEQ ID NO: 166 - protein, 234 aa, Pseudomonas syringae
MKIYLIWGATCTGKTEHSIKLSKSTGWPVIVLDRVQCCFDIATGSGRPHPEELQSTRRIYLDNRRISEGVISAEEANDRLKLEVNKHIDSGGVILEGGSISLLKLISKDPYWCDRFIWSQHRMRLQDTDVFMDKAKARVRRMLVGSTETTGLLDELVAAQSDLNAKLAIQDIDGYRYIMNYAQARRLSITQLLNVMTGDMKEELINGIALEYYEHAKWQERDFPAEWLAERSTR

SEQ ID NO: 167 - protein, 312 aa, Zymomonas mobilis
MSISESPKKHPVLLIAGPTASGKSQLAIAMGIKTNGIIINADASQLYTDLQILTARPSDADEKILPHRLFGIQDGSEPASAVFWAELAKKEIKNAHESGRLPILVGGTGLYIRTLLEGIAPIPDIAPELREEVRSMSVEEAYSALQQEDPMAADRLRPTDKTRIMRALEVMRSTGHPLHYWQQKKTGGIANEIKLQSFVIIPPANILRSRCDKRFDQMLEQGAEKEVIRLMGRQLPADLPIMRAIGVREIASYIRGEIDRLTMIEKAKAATRQYAKRQRTWFRHQTDESWIKIFDDINFKKIDDFAIKLLSI

SEQ ID NO: 168 - protein, 321 aa, Mesorhizobium loti
MSGIENSGADAGEGRVKNAILIAGPTASGKSALALDLAERAGGVIVNSDSMQGYSVLDVLTARPEAADLARVPHFLYGHVHPGTAYSTGAWLRDVMKLIDDGMLSRRPVFVGGTGLYFRALAEGISEMPDIPPRIRDRWRYELKEQGAVKLHGLLLREDSRAAMQLKPTDSQRIVRALEVLDASGRSILEWQAERGRPLIDRQTARFLVIEPDRAALVDRIERRFDQMLDKGALEEVRQLAALGLDPDLPAMKAIGVRDLQAAMAGQLSFPEAIERAKIATRQYAKRQATWFRHQLGPEWQRLRPGDDLETTMQTLVANAT

SEQ ID NO: 169 - protein, 357 aa, Arabidopsis thaliana
MTELNFHLLPIISDRFTTTTTTSPSFSSHSSSSSSLLSFTKRRRKHQPLVSSIRMEQSRSRNRKDKVVVILGATGAGKSRLSVDLATRFPSEIINSDKIQVYEGLEITTNQITLQDRRGVPHHLLGVINPEHGELTAGEFRSAASNVVKEITSRQKVPIIAGGSNSFVHALLAQRFDPKFDPFSSGSCLISSDLRYECCFIWVDVSETVLYEYLLRRVDEMMDSGMFEELSRFYDPVKSGLETRFGIRKAIGVPEFDGYFKEYPPEKKMIKWDALRKAAYDKAVDDIKRNTWTLAKRQVKKIEMLKDAGWEIERVDATASFKAVMMKSSSEKKWREIWEEQVLEPSVKIVKRHLVQN

SEQ ID NO: 170 - protein, 330 aa, Arabidopsis thaliana
MKPCMTALRQVIQPLSLNFQGNMVDVPFFRRKDKVVFVMGATGTGKSRLAIDLATRFPAEIVNSDKIQVYKGLDIVTNKVTPEESLGVPHHLLGTVHDTYEDFTAEDFQREAIRAVESIVQRDRVPIIAGGSNSYIEALVNDCVDFRLRYNCCFLWVDVSRPVLHSFVSERVDKMVEMGLVDEVRRIFDPSSSDYSAGIRRAIGVPELDEFLRSEMRNYPAETTERLLETAIEKIKENTCLLACRQLQKIQRLYKQWKWNMHRVDATEVFLRRGEEADEAWDNSVAHPSALAVEKFLSYSDDHHLEGANILLPEISAVPPLPAAVAAISR

SEQ ID NO: 171 - protein, 329 aa, Arabidopsis thaliana
MKFSISSLKQVQPILCFKNKLSKVNVNSFLHPKEKVVFVMGATGSGKSRLAIDLATRFQGEIINSDKIQLYKGLDVLTNKVTPKECRGVPHHLLGVFDSEAGNLTATQYSRLASQAISKLSANNKLPIVAGGSNSYIEALVNHSSGFLLNNYDCCFIWVDVSLPVLNSFVSKRVDRMMEAGLLEEVREVFNPKANYSVGIRRAIGVPELHEYLRNESLVDRATKSKMLDVAVKNIKKNTEILACRQLKKIQRLHKKWKMSMHRVDATEVFLKRNVEEQDEAWENLVARPSERIVDKFYNNNNQLKNDDVEHCLAASYGGGSGSRAHNMI

SEQ ID NO: 172 - protein, 113 aa, Plasmid pTiA6
QETFMKAAKARVKQMFDPAAGHSIIQELVYLWNEPRLRPILKEIDGYRYAMLFASQNQITADMLLQLDANMEGKLINGIAQEYFIHARQQEQKFPQVNAAAFDGFEGHPFGMY

SEQ ID NO: 173 - protein, 306 aa, Borrelia burgdorferi
MKEDRVVFIFGPTAVGKSNILFHFPKNKAEIINVDSIQVYKEFNIASSKPSKNLMKHIKHHLVDFLDPEKDYTIGIFYEQALKIVKEIRQKKKIPIFVGGTAFYFKHLKDGFPSTPLVTSKIRIYVNNLLELKGKSYLLKELKNVDPIRFNMLNKNDIYRIKRSLEVYYQTGIPISQFQKKQSSEFKNIVIIGLKRSFEDLKTRISIRINEMLNSGLLSEIKGLFSKGYNENTPAFKGIGYNEFLLWKSRPCYGLNDIIGLINKNSFLYAKRQMTFFAKISDVLWLHPEDDLDNILNLIFKVDKEI

SEQ ID NO: 174 - protein, 323 aa, Pseudomonas aeruginosa
MSSLPPAIFLMGPTAAGKTDLAMALADALPCELISVDSALIYRGMDIGTAKPSRELLARYPHRLIDIRDPAESYSAAEFRADALAAMAKATARGRIPLLVGGTMLYYKALLEGLADMPGADPEVRAAIEAEAQAEGWEALHRQLAEVDPESAARIHPNDPQRLMRALEVYRLGGVSMSDLRRRQSAEKADFDASGRNQLPYTVAQLAIAPEQRQVLHARIAQRFRQMLEQGFIAEVEALHARSDLHAGLPSIRAVGYRQVWDYLDGKLSYAEMTERGIIATRQLAKRQFTWLRSWSHLHWMDSLAGDNLPRALKYLKTVSILA

SEQ ID NO: 175 - protein, 357 aa, Pasteurella multocida
MPMPLPYSLKQSNCLIRNKLSDYPNYSSSLIGKLTWKKCNHMPLTTPTAIFLMGPTASGKTDLAIQLRQTLPVEVISVDSALIYRGMDIGTAKPSAEELALAPHRLIDICDPAESYSAANFRQDALREMADIIAAGKIPLLVGGTMLYYKALLEGLSPLPSADEKVRSEIEEKAQLQGWAALHQELAKIDPLAAQRINPNDSQRINRALEVFYLTGKSLSELSQQKGDSLPYQILQFAIAPKDRSILHDRIALRFQKMIEQGFQQEVEKLYQREDLHLDLPAMRCVGYRQMWEYLRGDYDHDEMIFRGICATRQLAKRQITWLRGWKYPIEWLDSLAIESAKQTIIHAVTKISHSNS

SEQ ID NO: 176 - protein, 311 aa, Rickettsia prowazekii
MIKKEIIILCGPTASGKSCLGHELAKAYDCEIINIDSMQVYKEIPIITASPIQIYNTDIHYHLYNFLSITEDFSVIKYLKLAAKKIKEITVRGKLPILIGGTGLYINLLVFGYNNIPDISEDLRVQVRNLHDKIGNIELWNQLKKLDPIASTKINHCDTQRLIRAYEVFMHTGKSIFSFHTAPKERILSDFNFKIIFLNPERKFLYKTCDERLDKIFKDKAIDEIALLKKQFTPEEYAHLKAVGIKEILAYLDGNLTLDAALNVAQMRTRQYAKRQVTWFTHQIQDKTILEYSTQEEFAQILRHLLFILRS

SEQ ID NO: 177 - protein, 339 aa, Chlamydia trachomatis
MSSSSSSGAATGFAVCSDPQKSFSKMFKRTVILLAGPTGSGKTAVSLKLAPLVDGEIISVDSMQVYQGMDIGTAKVSLTDRKEVPHHLIDVCHVQESFNAVDFYYHAVQACQDILSRNKVPILVGGTGFYFHTFLSGPPSGPSPDFVLREQLTLEAQERGISALYQELELLDPVYAATITKHDKNKIIRALEIIRKTGSKVSSYAWQSTVNESKEYHCRRWLLSPDPELLRHNILERCDQMLEEGLLDEVQALLAAGIKGNSSASRAIGYREWIEFLDLGSPPDLFEITKQKFITNTWRYTKKQRTWFKRYSLFRELRPMGMTLDDMAKKIAQDYFLCG

SEQ ID NO: 178 - protein, 305 aa, Aquifex aeolicus
MKILVIGGPTAIGKSDLACCVAQKLNGEIISADSMAVYKFMDIGTAKPLECMKKVPHHLIDVVEPGGYFDAKIFEEMAKEKIEEIKRKGKVPIVVGGTYLYIQALLYGIDETPKPDWNLRNKLYEIARKKGNDYLYEKLKAIDPKYAKKIHKNDLRRIVRALEVFINTGKPFSSFHSWNKPKMDFVGIYLKRSPESLYKRIENRVYDMVKDGLLEEVKKLLEMGYENFLTSGQAIDYKEFVPCAKGEKSLEECIKEAIKNTKKQAKRQIRWFRKQGWHEIDLDKLSIEEACEEVVRIYKDANKTK

SEQ ID NO: 179 - protein, 314 aa, Mycobacterium tuberculosis
MRPLAIIGPTGAGKSQLALDVAARLGARVSVEIVNADAMQLYRGMDIGTAKLPVSERRGIPHHQLDVLDVTETATVARYQRAAAADIEAIAARGAVPVVVGGSMLYVQSLLDDWSFPATDPSVRARWERRLAEVGVDRLHAELARRDPAAAAAILPTDARRTVRALEVVELTGQPFAASAPRIGAPRWDTVIVGLDCQTTILDERLARRTDLMFDQGLVEEVRTLLRNGLREGVTASRALGYAQVIAALDAGAGADMMRAAREQTYLGTRRYVRRQRSWFRRDHRVHWLDAGVASSPDRARLVDDAVRLWRHVT

SEQ ID NO: 180 - protein, 277 aa, Helicobacter pylori
MDAEIFSLDSLSIYEDINIASAKPSLKERKNIKHYALDYLNIDEKNNASLFKTLLEDAMRVSSKEILLIVGGSSFYLKSILEGLSGMPKLSDEEVVKIEREIATLSNPYIFLKSIDPNMAFKIHPNDTYRIHKALEIFYATHTPPSEYFKANPKKPFEHAISLFALSVEKNALANNIKQRTKSMLDCGLIEEIKALYIKYPKDSQPFKAIGVKESVLYLEKRLTLKELEEAIISNTMKLAKRQNTFNKTQFNNLYMGSVGEIRHAILKHSKSDTRER

SEQ ID NO: 181 - protein, 314 aa, Bacillus halodurans
MKEKLVAIVGPTAVGKTKTSVMLAKRLNGEVISGDSMQVYRGMDIGTAKITAEEMDGVPHHLIDIKDPSESFSVADFQDLATPLITEIHERGRLPFLVGGTGLYVNAVIHQFNLGDIRADEDYRHELEAFVNSYGVQALHDKLSKIDPKAAAAIHPNNYRRVIRALEIIKLTGKTVTEQARHEEETPSPYNLVMIGLTMERDVLYDRINRRVDQMVEEGLIDEAKKLYDRGIRDCQSVQAIGYKEMYDYLDGNVTLEEAIDTLKRNSRRYAKRQLTWFRNKANVTWFDMTDVDFDKKIMEIHNFIAGKLEEKSK

SEQ ID NO: 182 - protein, 302 aa, Buchnera aphidicola
MGPTACGKSQLAICLRKYLSIELISVDSALIYRGMDIGTDKPSFSDLYNHPHRLLNIKDPVENYSAAEFQKDVLREIDEIIKLGKIPCLVGGSMFYYNVLLHGLSILPPSNIKLREYLIQKSYEKNYLYKKLKLIDPISASRIHKNDFQRLIRALEIFYLSGKSLTELKKKNNYKLPYNIFQFAIIPPNKEWLNNKIELRIKKMLMLGFQKEVEILFLRGDLHKNLPSIRCIGYRQMWEYLEYKNSYKDMFNKIIHATRKLAKHQLTWLKNWKNINKIEYHSTSTILAKKVLDVLEKNDFSV

SEQ ID NO: 183 - protein, 342 aa, Chlamydophila pneumoniae
MLPFEFEFNTTSSPECDVCLDPQKLFVKLFKRTIVLLSGPTGSGKTDVSLALAPMIDGEIVSVDSMQVYQGMDIGTAKVSLKARQEIPHHLIDIRHVQEPFNVVDFYYEAIQACQNILSRNKVPILVGGSGFYFHAFLSGPPKGPAADPQIREQLEAIAEEHGVSALYEDLLLKDPEYAQTITKNDKNKIIRGLEIIQLTGKKVSDHEWDIVPKASREYCCRAWFLSPETEFLKNNIQMRCEAMLQEGLLEEVRGLLNQGIRENPSAFKAIGYREWIEFLDNGEKLEEYEETKRKFVSNSWHYTKKQKTWFKRYSIFRELPTLGLSSDAIAQKIAKDYLLYS

SEQ ID NO: 184 - protein, 316 aa, Treponema pallidum
MRLETQALVPYPVRFDRSHHDALVVLGATATGKTALAVALAQKYQGEIISADSRQVYRGLDVGTGKDLALYGSVPYHLIDVCDPYEEYNVFRFQQAVYGIVPSILRAHKVPIIVGGTGLYLDAVLRQYALVPVERNQALRASLRGASLSHMRAVYFSLKDSHAVHNKTDLEDPARLMRAIEIAVFHATHPELLQQARETRPMMRAKVYGIQYPRSMLRARIRARLEQRIRGGLIEEVAALHKGGVSWQRLEYFGLEYRFTAQYLQGIIATRDEYVDLLFRAISRFAKRQETWFRRMQRLGVKIHWLVHTENGFVLR

SEQ ID NO: 185 - protein, 315 aa, Vibrio cholerae
MTQKLPLALFLMGPTASGKTDLAIRLRQKYPVEIISVDSALIYRGMDIGTAKPDAQELALAPHRLIDILDPSEAYSAADFRRDALKEMADIVAQGKIPLLVGGTMLYFKALLEGLSPLPAADPVIRQQIELEAEKLGWQALHDQLQQIDPVSAQRIHPNDPQRLSRALEVYRISGKTLTELTQTKGEAIPYRVLQFAIAPKERAELHRRIELRFEKMVESGFEEEVKALYARDDLHPDLPSIRCVGYRQMWDYLDGHGTLDEAIYRGICATRQLAKRQITWLRSWDDLTWLDSENVDQAVETLSNAIASNEISCV

SEQ ID NO: 186 - protein, 305 aa, Thermotoga maritima
MKIAIVGGPTAVGKTDIMIEVCEEIGAEIISMDSRQIYRYMDIGTAKPTPEQRKRVLHHMIDIIDPDEYYNAFMYRKDSLRAMEDVLRRGKIPVYVGGTGLYADALVRGIFEGVPADENIRKELRELERREPGILRKMLEELDPEAATRIHPNDLKRTIRALEVYMKTGRRISELQKEAKGDDRFFIIVLTRERYELYERINKRVDKMIEMGLVDEVKRLLGMGYSKDLNSMKTIGYKEVIDYLEGKYDFDKMVHLIKRNTRHFARRQIIWFKRYKEAVWYNLTFEDVGEVKEKLKKLIVENFSV

SEQ ID NO: 187 - protein, 266 aa, Helicobacter pylori
MSIYKDINIASAKPSLKERKNIKHYALDHLNIDEKNNAPLFKTLLEDAMRVSSKEILLIVGGSSFYLKSILEGLSRMPKLSGEEVVKIEREIATLSNPYIFLKSIDPNMAFKIHPNDTYRTHKALEIFYATCTPPSEYFKANPKKPFEHAISLFALSIEKSALHNNIKRRTKNMLHSGLVEEIKALYTQYPKDSQPFKAIGVKESVLFLEKRLTLKELEEAITSNTMKLAKRQNTFNKTQFNNLYVGSAEEVRHAILKHSKSGIKG

SEQ ID NO: 188 - protein, 294 aa, Lactococcus lactis
MKNNKVLVVVGPTAVGKTALGIDLAIKFNGEIISGDSQQVYQGLDIGTAKVTMAEQAQVPHHLIDVRKWTENFSVHDFVIEANQLIKEILDQGKVPIIVGGTGLYIQSLIEGYHLGGQENHEEMMKLREELSLLSDEELFAKVIKINPDISELNRRRAIRFLELQTFGSQDENLGSDYDFLLIGLNADRKVLYDRINQRVDQMMREGLLDEARTLYEQAPEVQAAKGIGYKEFFPYFSGDISLEEAVELVKRNSRRYAKRQLTWFKNRMSVEFEDVFSKNYPEPIFDKVTQFLN

SEQ ID NO: 189 - protein, 299 aa, Streptococcus pyogenes
MTKIKIVVIVGPTAVGKTALGISLAKAFNGEIISGDSQQVYRQLDIGTAKATQEEQEAAVHHLIDIREVTESYSAYDFVQDAQKSISDIVSRGKLPIIVGGTGLYLQSLLEGYHLGGQVDQEAVKAYRNELEQLDDHDLYERLQVNNITIEQVNRRRAIRALELAQFADELENAETAYEPLIIGLNDDRQVIYDRINQRVNRMIENGLLEEAKWLYEHYPTVQASRGIGYKELFPYFVGEMTLAEASDQLKQNTRRFAKRQLTWFRNRMAVSFTAITAPDYPQVVHDRVRDFLGQKEKS

SEQ ID NO: 190 - protein, 313 aa, Neisseria meningitidis
MPTPKAFALLGPTAGGKTALALKIAETLPVEIISLDSALVYRDMDIGTAKPSASERAFVPHHLIDIIPPTESYSAARFVEDCTRLVGEISSRGRFALIVGGTMMYFRALTQGLNDLPEADACLRADLDEQKQMYGLDFLYRTLQKVDPETACRLKPNDSQRIGRALEVYYLTGKPMSTHLGSLTSHTLPFDLHTAALIPENRARLHENIALRFHLMLEQGFIGEVENLRRRYPGLTAYSPAIRCVGYRQAWKYLDGKTDFPAFVEKGIAATRQLAKRQLTWLRKTPLDCVADPFSDCTSCTRLIEAAKRFFGA

SEQ ID NO: 191 - protein, 289 aa, Campylobacter jejuni
MFFEIALIGTTASGKTYIANTLAREFNAVVLSLDSLCVYKEINIASAKPSQDDLASIKYFGVNLLSVNEHFNVELFIREYQKAKEFALARNLPLIIVGGTGFYLKTMIDGLSEKTLESKSSLNNDEIYALLLNIDPNYKIEKNDTYRLKKWLGIYEQTREIPSEFLKRTQKTGVLKDIEIYELAWDKEILKKRIKTRTKEMLDNGLLDEAKILFSKFDHKLKALNSIGLKECKEYLDGEISFKELENLITIHTTQLAKRQRTFNKKFQSKALEFDKALATLRMKFSIEK

SEQ ID NO: 192 - protein, 313 aa, Neisseria meningitidis
MPTPKAFALLGPTAGGKTALALKIAETLPVEIISLDSALVYRDMDIGTAKPSASERAFVPHHLIDIITPVQTYSAARFVEDCTRLIGEITARGKYPLIVGGTMMYFRALTQGLNDLPEADACLRADLDEQKQMYGLDFLYRTLQQVDPETACRLKPNDSQRIGRALEVYYLTGKPMSEHLGRQSPHTLPFDLHTAALIPENRARLHENIALRFHLMLEQGFIGEVENLRRRYPSLTADSPAIRCVGYRQAWEYLDGATDRQTFIEKGIAATRQLAKRQLTWLRKTPLDCVADPFSDGTSCTRLIEAAKRFFGV

SEQ ID NO: 193 - protein, 316 aa, Escherichia coli
MSDISKASLPKAIFLMGPTASGKTALAIELRKILPVELISVDSALIYKGMDIGTAKPNAEELLAAPHRLLDIRDPSQAYSAADFRRDALAEMADITAAGRIPLLVGGTMLYFKALLEGLSPLPSADPEVRARIEQQAAEQGWESLHRQLQEIDPVAAARIHPNDPQRLSRALEVFFISGKTLTELTQTSGDALPYQVHQFAIAPASRELLHQRIEQRFHQMLASGFEAEVRALFARGDLHTDLPSIRCVGYRQMWSYLGGEISYDEMVYRGVCATRQLAKRQITWLRGWEGVHWLDSEKPEQARDEVLQVVGAIAG

SEQ ID NO: 194 - protein, 306 aa, Deinococcus radiodurans
MAAPLIPVLTAPTAAGKTALALRLAREYGLEIVAADAFTVYRGLDLGTAKPTPQERASVPHHLLDVVDVTQSYDVAQYAAQAEAAIVDILARGRLPLVVGGTGFYLSALSRGLPLTPPSDPKMRAALEAELQERGLDALLAEIEQANPAEAARMERNPRRVVRALEVYRAAGRFPGEFGYSPPAFQYQVFAFSPPAAEMEQRVQERTAAMLRAGWPQEAQWLAGQVPPEQEPRPTVWQALGYAEALAVAQGRLSLAGAEQAIALATRQYGKRQLTWMRRQLGAEVQSPDAAEAHLRAFLERSGAPS

SEQ ID NO: 195 - protein, 311 aa, Mycobacterium leprae
MRPLAIVGPTGVGKSELALDVIERLGGQVSVEIVNADAMQLYRGMDIGTAKLPVAARRGIPHHQLDVLDVTETATVASYQRTAAADIEAIAARGAVPVVVGGSMLYVQSLLDDWSFPGTDPAVRVRWEQQLAEVGVVRLHAELARRDLAAAAAILPTDGRRTVRALEVVELTGKPFAASAPRIGAPRWDTVIVGLDCDRTILSERLARRIDSMFGQGLVDEVRMLLRWGLRDGVTASRALGYAQVLTALDAGGDADHLDEARQQTYLGHRRYARRQRSWFHRDHRVHWLDVGTVDRVGVVDDALRVWRNAS

SEQ ID NO: 196 - protein, 314 aa, Chlamydia muridarum
MFKRTVILLAGPTGSGKTAVSLKLAPLVDGEIISVDSMQVYQGMDIGTAKVSLAIRQAVPHHLIDICHVQETFNAVDFYYHAIQACQDILSRNKVPILVGGTGFYFHTFLSGPPSGPSPDFALREQLSLEAQERGIGALYQELVELDSAYAATITKHDKNKIIRALEIIRKTGNKVSSYSWESTVNESKEYHCRGWLLSPDPELLRHNILERCDQMLEEGLVDEVRSLVALGIKGNTSASRAIGYREWIEFLDAGSPVERFEDTKQKFITNTWRYTKKQRTWFKRYPLFRELSPMGMTLGDIARKIAQDYFLCG

SEQ ID NO: 197 - protein, 317 aa, Xylella fastidiosa
MPADTRPAAIVLMGPTASGKSQLAIDIAKRWGGEVISVDSVLVYRGLDIGTAKPNAAMRASVPHHLIDICEPWETYSAADFAHDARAAIDMIVRRGALPILTGGTGLYFRALLAGLSDMPPAHPEIRAMITAEAKRDSWATLHTRLAEVDAITAARIHATDPQRIQRALEVYRVSGRSMSDWQKQPLKQRLPLRVLKLVLAPTHRKVLHFRIAQRFKAMLDNGLLAEVNALRTHPSIHAMARPLNLPAMRAVGYRQCWEHLDNMYTAETLYQRGVAATRQLAKRQLTWLRGELDALWFDPEHDQSRIEKVVEAFLNR

SEQ ID NO: 198 - protein, 326 aa, Agrobacterium tumefaciens
MTAFAAASPRAAVRTGFDGLAISVATRAMMKNLDQNFDAILITGPTASGKSALALRLARERNGVVINADSMQVYDTLRVLTARPSDHEMEGVPHRLYGHVPAGSAYSTGEWLRDISGLLSDLRGEGRFPVIVGGTGLYFKALTGGLSDMPAIPDDLREGLRARLIEEGAAKLHAELVSRDPSMAQMLQPGDGQRIVRALEVLEATGKSIRDFQRASGPMIIDPERAQKFIVLPERPVLHDRINRRFEAMMDSGAVEEVQALLALNLAPDATAMKAIGVAQIADMLTGRMGAAEVIEKSAAATRQYAKRQMTWFRNQMGDDWTRIQP

SEQ ID NO: 199 - protein, 363 aa, Rickettsia conorii
MLACNDDTSLYLLVKQVTKKEIYSNDLENGNVKRGASMQSLYLIGDPKCCRNNSSKQKSIIILCGPTASGKSYLGHELAKAYNGEIINIDSMQVYKEIPIITASPPKSYKTEILYHLYNFLSMTEDFSVIKYLKLATEKIKEITDRGKLPILIGGTGLYINSLVFGYNNIPDISEDLQEQVRNLHVKIGNIELWSKLEKFDPLAASKINQNDTQRLIRAYEVFMQTGKSIFSFQTLPKEQILSDFNFKIIFLNPERKFLYKTCDERLDKIFKEGAIDEIALIKKQFAPKDYTNLKAVGIKEILAYLNGNLTLDEALNAAQIRTRQYAKRQVTWFKNQIQDKITLEYANQEEFTQTLKNPFKII

SEQ ID NO: 200 - protein, 309 aa, Clostridium acetobutylicum
MKDILIIAGPTAVGKTDISIKIAQKMNGEIISADSMQIYKYMDIGSAKVTKEEMKGIKHHLIDVVDPSEEFSVASFKKMAQNAIDDITSRKKYPIIVGGTGLYINSLICNYDFTGAYKDEAYRESLQAIAKDKGKEYLHEKLKNIDIDSYKKLYPNDLKRVIRALEVYKITGKTISELNSNVDLYDIPYNIHYFILNMDRQKLYERINLRVDIMLRNGLVDEVIKLRDMGYNSNMQSMKGIGYKEILSYLEGCITLEEAVELIKKGSRHYAKRQLTWFRKDERAVWINKDIYKNDDDIVFKILSSIEEI

SEQ ID NO: 201 - protein, 294 aa, Streptococcus pneumoniae
MKTKIIVIVGPTAVGKTALAIEVAKRFNGEVVSGDSQQVYRGLDIGTAKASPEEQAAVPHHLIDVREITESYSAFDFVSEAKMTIEGIHNRGKLAIIAGGTGLYIQSLLEGYHLGGETPHEEILAYRASLEPYSDEELAHLVDQAGLEIPQFNRRRAMRALEIAHFGQDLENQETLYEPLIICLDDERSQLYERINHRVDLMFEAGLLDEAKWLFDHSPNVQAAKGIGYKELFPYFRGEQTLEEASESLKQATRRFAKRQLTWFRNRMQVTFYQIGESGVQDRILSQIEEFLDD

SEQ ID NO: 202 - protein, 311 aa, Streptococcus pneumoniae
MCYNNSNEKMGIFQGKKMKTKIIVIVGPTAVGKTALAIEVAKRFNGEVVSGDSQQVYRGLDIGTAKASPEEQAAVPHHLIDVREITESYSAFDFVSEAKMTIEDIHSRGKLAIIAGGTGLYIQSLLEGYHLGGETPHEEILAYRASLEPYSDEELAHLVEQAGLEIPQFNRRRAMRALEIAHFGQDLENQEILYEPLIICLDDERSQLYERINHRVDLMFEAGLLDEAKWLFDHSPNVQAAKGIGYKELFPYFRGEQTFEEARESLKQATRRFAKRQLTWFRNRMQVTFYQIGESGVQDRILSQIEEFLDD

SEQ ID NO: 203 - protein, 311 aa, Staphylococcus aureus
MNKNKPFIVVIVGPTASGKTELSIELAKRINGEIISGDSMQVYKHMNIGTAKVTPEEMDGIPHHLIDILNPDDTFSAYEFKRLAEDLITDITNRGKVPIIAGGTGLYIQSLIYNYELEDETVTPAQLSIVKQKLSALEHLDNQQLHDYLAQFDAVSAENIHPNNRQRVLRAIEYYLKTKKLLSNRKKVQQFTENYDTLLLGIEMSRKTLYSRINKRVDIMLDHGLFREVQQLVEQGYESCQSMQAIGYKELIPVINGQMIYEDAVNDLKQHSRQYAKRQMTWFKNKMSVHWLDKENMSLQMMLDEITTQIK

SEQ ID NO: 204 - protein, 303 aa, Sinorhizobium meliloti
MMQNLARDIDAILITGPTASGKSALAVKLAQRHGGVVINADSMQVYGTLKVLTARPDQSEMGGVEHFLYGHIPPGRAYSTGVWLREAEALVARLGKEGRLPVFVGGTGLYFKALTGGLSDMPEIPLETRKRLRTRLTEEGAEALHGELSARDPETAGRVRPSDGQRIVRALEIIEATGRPIGSYQQSRGPVIIDPARAQKIVVLPERPVLHGRIDRRFETMLARGAVEEVRALLALRLPPEMPVMKAIGVPQIAAMLKGEMSEKQVIEAGAAATRQYAKRQMTWFRNQLDETWQRIEDPDALG

SEQ ID NO: 205 - protein, 314 aa, Bacillus subtilis
MNNTKQPVVILVGPTAVGKTNLSIQLAKSLNAEIISGDSMQIYKGMDIGTAKITEQEMEGVPHHLIDILDPQDSFSTADYQSLVRNKISEIANRGKLPMIDGGTGLYIQSELYDYTFTEEANDPVFRESMQMAAEREGADFLHAKLAAADPEAAAAIHPNNTRRVIRALEILHTSGKTMSQHLKEQKRELLYNAVLIGLTMDRDTLYERINQRVDLMMQSGLLPEVKRLYDKNVRDCQSIQAIGYKELYAYFDGFVTLSDAVEQLKQNSRRYAKRQLTWFRNKMQVTWFDMTPPVDMELKKKEIFTHIAGKLEL

SEQ ID NO: 206 - protein, 249 aa, Agrobacterium tumefaciens
MYSRYRKKLMDLRLIFGPTCTGKTSTAVALAQQTGLPVLSLDRVQCCPQLSTGSGRPTVEELKGTSRLYLDDRPLVKGIIAAKQAHERLMGEVYNYEAHGGLILEGGSISLLKCMAQSSYWSADFRWHIIRHELADEETFMNVAKARVKQMLRPAAGLSIIQELVDLWKEPRLRPILKEIDGYRYAMLFASQNQITSDMLLQLDADMEDKLIHGIAQEYLIHARRQEQKFPRVNAAAYDGFEGHPFGMY

SEQ ID NO: 207 - protein, 262 aa, Agrobacterium tumefaciens
MKNLVWNRWDIPLNLYEAHMLLHLIYGPTCSGKTDMAIQIAQETGWPVVALDRVQCCPQIATGSGRPLESELQSTRRIYLDSRPLTEGILDAESAHRRLIFEVDWRKSEEGLILEGGSISLLNCMAKSPFWRSGFQWHVKRLRLGDSDAFLTRAKQRVAEMFAIREDRPSLLEELAELWNYPAARPILEDIDGYRCAIRFARKHDLAISQLPNIDAGRHVELIEAIANEYLEHALSQERDFPQWPEDGAGQPVCPVTLTRIR

SEQ ID NO: 208 - protein, 313 aa, Yersinia pestis
MNDIENLDRPPAIFIMGPTASGKTALSIALRQRLPVELVSVDSALIYRGMDIGTAKPSAQELALAPHRLIDIRDPAESYSAADFRKDALKEMADITAAGRIPLLVGGTMLYFKALLDGLSPLPSADPQVRQRIEQQASELGWGALHQQLAVIDPVAAARIHPNDPQRLSRALEVFFISGKTLTELTKISGETLPYRVHQFAIAPASRELLHQRIELRFHQMLDAGFEAEARVLFDRGDLHTDLPAIRCVGYRQMWSYLSGEIDYNDMVYRGVCATRQLAKRQMTWLRGWSSVQWLDSDKPGEALDSVIQVVSA

SEQ ID NO: 209 - protein, 295 aa, Caulobacter crescentus
MESSDIASRIWLIAGPTASGKSAYALDLAERIDGEIVNADSMQIYAGLRVLTAGPSQEETARAPHHLFQIVDPALGWSVGRWLEAATQALAEIQARGKPAIVVGGTGLYFRALTHGLADVPPVPETQREISSLLYAARGETEFREILKPLDPEAEARIESGDRQRLVRAHAVAITTGKSLTAWQTDTKPALAPGSWKGLVLDPPRAELYARCDARLAVMVEQGALDEVRALETRGLDPALPALKAVGYREFAAHLRGETSLDQALDAARQETRRYAKRQLTWFRNQTPDWERIVP

SEQ ID NO: 210 - protein, 316 aa, Escherichia coli
MSDISKASLPKAIFLMGPTASGKTALAIELRKILPVELISVDSALIYKGMDIGTAKPNAEELLAAPHRLLDIRDPSQAYSAADFRRDALAEMADITAAGRIPLLVGGTMLYFKALLEGLSPLPSADPEVRARIEQQAAEQGWESLHRQLQEVDPVAAARIHPNDPQRLSRALEVFFISGKTLTELTQTSGDALPYQVHQFAIAPASRELLHQRIEQRFHQMLASGFEAEVRALFARGDLHTDLPSIRCVGYRQMWSYLEGEISYDEMVYRGVCATRQLAKRQITWLRGWEGVHWLDSEKPEQARDEVLQVVGAIAG

SEQ ID NO: 211 - protein, 311 aa, Haemophilus influenzae
MKPTAIFLMGPTASGKTDLAIQLRSQLPVEVISVDSALIYKGMDIGTAKPSKEELALAPHRLIDILDPSESYSAMNFRDDALREMADITAQGKIPLLVGGTMLYYKALIEGLSPLPSADENIRAELEQKAAQQGWAALHTELAKIDPISAARINPSDSQRINRALEVFYITGKSLTELTEEKGEALPYDFVQFAIAPQDRHVLHERIEQRFHKMIELGFQAEVEKLYARGDLNINLPSIRCVGYRQMWEYLQGDYAYEEMIFRGICATRQLAKRQLTWLRGWKTPIQWLDSLQPQQAKETVLRHLDSYQKG

SEQ ID NO: 212 - protein, 303 aa, Synechocystis sp.
MAKVPPLIVICGTTASGKSQLALDLAQRLNAVILGADSRQIYKELDIGTAKPTLGDRQTVPHYLIDICEPTENFTLAEYQRQAQELIASLNQPILLVGGTGLYIQAIVKGLKIPAVPPQTNLREQLANLGQPFCYQLLSQVDPVAQSKIEPADVVRTLRALEVFYATGRPISSLQGENPPSYPIVQIGLGLEPEQLQPRIVHRTHAMVEAGLVKEVEGLINQYGEDLPLLHTLGYAEIKQYLQGQISLTQATESIIVHTRQFAKRQRTWFRKDSAIHWFDANQPNLLDSVTKLVQVDVNEGMF

SEQ ID NO: 213 - protein, 316 aa, Salmonella enterica
MNDVSKVSLPKAIFLMGPTASGKTALAIELRKVLPVELISVDSALIYRGMDIGTAKPNADELKAAPHRLLDIRDPSQAYSAADFRRDALAQMAEITAAGRIPLLVGGTMLYFKALLEGLSPLPSADPEVRSRIEQQAAELGWEALHQQLQEIDPVAAARIHPNDPQRLSRALEVFFISGKTLTELTQTSGDALPYQVHQFAIAPASRELLHQRIELRFHQMLASGFEAEVRALFARGDLHTDLPSIRCVGYRQMWSYIEGEISYDEMVYRGVCSTRQLAKRQMTWLRGWEGVRWLDSENPDRARKEVLQVVGAIAD

SEQ ID NO: 214 - protein, 316 aa, Salmonella typhimurium
MNDVSKASLPKAIFLMGPTASGKTALAIELRKVLPVELISVDSALIYRGMDIGTAKPNADELKAAPHRLLDIRDPSQAYSAADFRRDALAQMAEITAAGRIPLLVGGTMLYFKALLEGLSPLPSADPEVRSRIEQQAAELGWEALHQQLQEIDPVAAARIHPNDPQRLSRALEVFFISGKTLTELTQTSGDALPYQVHQFAIAPASRELLHQRIELRFHQMLASGFEAEVRALFARGDLHTDLPSIRCVGYRQMWSYIEGEISYDEMVYRGVCATRQLAKRQMTWLRGWEGVRWLDSENPDRARKEVLQVVGAIAD

SEQ ID NO: 215 - protein, 305 aa, Listeria innocua
MSKIPVIVIVGPTAVGKTSLSITLAKNFDGEIISGDSMQVYRGLDIGTAKITPEEMDGIKHYLIDVTDPAVPFTAAKFQAETRGLIESIHNRGKLPIIVGGTGLYIQSVFYDYGFGNASEDKAYRRELDQLDKTTLWQMLDQLDPKSAELIHENNKRRVIRALEVIHLTGKPFSEYQVHHTLNEAYQPLFLGLDLDRELLYERINRRVELMFEEGLVSEASKLYDEHLVDVPAIRGIGYKELFTYFDGNSSLEEAKELIQKNSRHFAKRQLTWFRNRMDIDWIQAGVSTTDTEAMEKVKTFLASK

SEQ ID NO: 216 - protein, 305 aa, Listeria monocytogenes
MSKIPVIVIVGPTAVGKTSLSIELAKKLDGEIISGDSMQVYRGLDIGTAKITPEEMDEIKHYLIDVTDPSEPFTAAKFQTETRKWIETIHQAGKLPIIVGGTGLYIQSVFYDYDFGNVSEDKAYRAELEQLNKTLLWQMLEQQDPESAAQIHENNKRRVIRALEVMHLTGKPFSEYQVHNVLNDTYKPLFLGLDLDRALLYERINQRVNLMFEEGLVTEAKKLYDQHLVDVPAVCGIGYKELFPYFEGKSSLEEAKELIQKNSRHFAKRQLTWFRNRMEIDWIQAGVSTTEAEALNKAETFLSVK

SEQ ID NO: 217 - protein, 427 aa, Saccharomyces cerevisiae
MLKGPLKGCLNMSKKVIVIAGTTGVGKSQLSIQLAQKFNGEVINSDSMQVYKDIPIITNKHPLQEREGIPHHVMNHVDWSEEYYSHRFETECMNAIEDIHRRGKIPIVVGGTHYYLQTLFNKRVDTKSSERKLTRKQLDILESTDPDVIYNTLVKCDPDIATKYHPNDYRRVQRMLEIYYKTGKKPSETFNEQKITLKFDTLFLWLYSKPEPLFQRLDDRVDDMLERGALQEIKQLYEYYSQNKFTPEQCENGVWQVIGFKEFLPWLTGKTDDNTVKLEDCIERMKTRTRQYAKRQVKWIKKMLIPDIKGDILLDATDLSQWDTNASQRAIAISNDFISNRPIKQERAPKALEELLSKGETTMKKLDDWTHYTRNVCRNADGKNVVAIGEKYWKIHLGSRRHKSNLKRNTRQADFEKWKINKKETVE

SEQ ID NO: 218 - protein, 244 aa, Nostoc sp.
MRLHIILGPTSVGKTDRSVVLAKQTKAPVIVLDRIQIYQEIATGSGRPLIDELEGTTRIYLEERQLADGNLNTLESLSLALQHIDRLSSQHKLLILEGGSISLCTALWKSRILENYQTTIEYVKVENEELYQSRLWRRMQNALISNPRRPSLIEELSRVWQDPHKLALVRTVVGYDVLIHWCQKYGLSPDQMWKSFQDNSFYINLMQEMFLAYMQYSQNQRQAFDQLAVEYKQQQALLASTVTL

SEQ ID NO: 219 - protein, 295 aa, Nostoc sp.
MTKLIVICGATATGKSGLALNLAMRLGSVILSADSRQVYREFDIGTAKPTLAEQRAVPHYLIDICAPRETMTVADYQEQAQALINSLPVSPLLLVGGTGLYIRSIVQGMKIPRVAPNYELRSQLASLGQTTLYGILQQVDPIAAQKIHPNDPVRTLRAVEVFYITGIPISAQQGENPPDYPILQIGLDCEMERLTERIHKRTEQMITDGLVGEVEYLCQKYGAELPLLNTLGYQEIKQYLTGEISLEAAKELTVLHTRQFAKRQRTWFRASPQIEWFNADHPDLLDIVCQHIQQP

SEQ ID NO: 220 - protein, 323 aa, Ralstonia solanacearum
MTAAPHTAPRAVCLLGPTASGKTAAALALAERWPVEIISMDSALVYRDMDIGTAKPSRAEQAIAPHHLIDIIDPLDAYSAAQFATDAQALIEAIRARGRLPLIVGGTMLYYKALTQGLSDLPGADPAIRAEIDAEAARDGWPALHAKLAQVDPVTAARLHATDAQRIQRALELYRLTGQPMSALLAREAGAAAFHRHEAAAAYLSIALEPADRAVLHARIAQRFDAMLAGGLLDEVEALRRRGDLSPVLPSIRCVGYRQAWAYLDGEIDMATLREQGIAATRQLCKRQITWLRSTPERRVVDCLAPDYVDQVARLVRNALETP

SEQ ID NO: 221 - protein, 238 aa, Ralstonia solanacearum
MPVRLYLIWGATTTGKTAQSVALARSAGAPVISLDRVQCCHELAVGSGRPSPSELLGTRREYLCEREVSRGVVSAAEANQLLLDKVARYATQERALILEGGSVSLINAMIRDARWSERGEWILRRIPVPGRAAFMAAARKRVREMLDPPPGQAGILDELQGLWGYPRNHAVLEDIDGYRQIIRYANALQVPICRITSIDPNAKALLIERIAQEYWEHALWQEQEFLGIPASWMRADDA

SEQ ID NO: 222 - protein, 298 aa, Agrobacterium tumefaciens
MMKNLDQNFDAILITGPTASGKSALALRLARERNGVVINADSMQVYDTLRVLTARPSDHEMEGVPHRLYGHVPAGSAYSTGEWLRDISGLLSDLRGEGRFPVIVGGTGLYFKALTGGLSDMPAIPDDLREGLRARLIEEGAAKLHAELVSRDPSMAQMLQPGDGQRIVRALEVLEATGKSIRDFQRASGPMIIDPERAQKFIVLPERPVLHDRINRRFEAMMDSGAVEEVQALLALNLAPDATAMKAIGVAQIADMLTGRMGAAEVIEKSAAATRQYAKRQMTWFRNQMGDDWTRIQP

SEQ ID NO: 223 - protein, 64 aa, Agrobacterium tumefaciens
MDLYLIFGPTCTGKTAAAITLSEHTGIPVLALDRIQCCPQLSTGSGRPMAAEYTAPQSLGQKRC

SEQ ID NO: 224 - protein, 243 aa, Agrobacterium tumefaciens
MLLHLIYGPTCSGKTDMAIQIAQETGWPVVALDRVQCCPQIATGSGRPLESELQSTRRIYLDSRPLTEGILDAESAHRRLIFEVDWRKSEEGLILEGGSISLLNCMAKSPFWRSGFQWHVKRLRLGDSDAFLTRAKQRVAEMFAIREDRPSLLEELAELWNYPAARPILEDIDGYRCAIRFARKHDLAISQLPNIDAGRHVELIEAIANEYLEHALSQERDFPQWPEDGAGQPVCPVTLTRIR

SEQ ID NO: 225 - protein, 310 aa, Brucella melitensis
MSEDAVKNAILIAGPTASGKSALAIRMAKATGGFIVNTDSMQVYGVLDLLTARPSRANLAEAEHFLYGHVPPSSTYSTGKWFEDVEALLGRCELQGRVPIFVGGTGLYFRALLGGLSQTPEVSAQVRDHWRGRMEAEGAKALHAVLCVRDPAIAAALQPSDSQRIVRALEVLESTGKSLLEWQKVKGRALVDDQSAQKIVLRPDRAWLGVRIARRFSAMWAEGAIDEVRALLALDLDPALPAMKAIGVREVSAFLAETMSREEAIERSVIATRQYAKRQSTWFRNQLGEDWRVYASGEEVFQGGSFRDPQ

SEQ ID NO: 226 - protein, 240 aa, Agrobacterium vitis; identical to SEQ ID NO: 17

SEQ ID NO: 227 - protein, 310 aa, Clostridium perfringens
MNNNLLIIAGPTAVGKSDLSVDLAKKLNGEIISVDSMQIYKYMDIGSAKISKEEMGGIPHYLIDFVDPSKEFSVAEFKDLTTEKIKDIQSRGKLPILVGGTGLYINSIICNMNFAESDKDEEYREELEKIANEHGNEYLHEMLKDIDLESYNSIHFNNRKRVIRALETYKLTGKPFSSFKAKNSIYETPYNIYYYVLNMDRAKLYDRINKRVDIMFEKGLLEEVKNLKAMGLTDDMQSMKGIGYKEVLYYLDGKISLEQCIEMIKQGSRNYAKRQLTWFRKDPRAIFIDKDTFASEEDISSKIINDIINS

SEQ ID NO: 228 - protein, 350 aa, Petunia x
MLIVVHIISITRIIFITLTHNHLHFLMFRSLSYNHKHLKFLTNPTTRVLRRNMSSSTVVTIPGPTQKNKNKIIVIMGATGSGKSKLSIDLVTRHYPFSEIINSDKIQITKGLNITTNKITVPDRRGVVHHLLGEIDPDFNFSPSHFRSIAGQRINSIINRHKLPFLVGGSNSYIYALLTNRFDPDFNPDSNPVHFISNELRYNCCFIWVDVLNPVLNEYLDKRVDEMMNSGMYEELEQFFKENRFSDPGLEPGRATGLRKAIGVPEMERYFKKSCTYEEAVREIKENTWRLAKKQMWKIQRLREAGWDLQRVDATEAFVEAMSNKKEKGIIWEKQVVEPSVKIVNRFLLD

SEQ ID NO: 229 - protein, 434 aa, Schizosaccharomyces pombe
MLKPLCVVIGTTGAGKSDLAVQLAKRFGSQVINADSMQIYRGFDTITNKITVEEQENVHHRLMSFLNFDKEYSVPEFERDASRVIDEIHSQGKIPIVVGGTHYYLQSLLFEDTTLSAIDKLTNDSSPSKPPHPDSHILDDDPSAMLSYLKKIDPVMAEQWHPRDTRKIRRSLEIYFHTGRPPSEIYSEQKMKSSGSKLRYKSLIFWAFADSLVLMPRLDKRVDKMLSHGLVDEIKSMKSLAESEKFSPDFTRGIWQCIGFKEFMPWFEAPSDIVFNDCLERMKVSTRQYAKSQKKWIQSRFLPMCLAQQDLSPSSILFSTTNTTDLNNWEEQVEKACRVFQYFFYNGDAIAPSADDQHAFEKARDYLSIMNGRQSQKKKFVCEECLDKRGDPFTVIGEDAFNVHIKSRKHKTTVRRKKERAERQIRLKNIGILK

SEQ ID NO: 230 - protein, 330 aa, Arabidopsis thaliana
MQQRIPRSVVQMLLQDMVVESVFGRDDLSHGYELLKELDPVAANRIHPNNHRKINQYLSLHASRGVLPSKLYQGKTAENWGCINASRFDYCLICMDAETAVLDRYVEQRVDAMVDAGLLDEVYDIYKPGADYTRGLRQSIGVREFEDFLKIHLSETCAGHLTSLSNDDKVMKENLRKILNFPKDDKLRIMLEEAIDRVKLNTRRLLRRQKRRVSRLETVFGWNIHYIDATEYILSKSEESWNAQVVKPASEIIRCFLETETESGRDPTSGKSIERDLWTQYVCEACGNKILRGRHEWEHHKQGRTHRKRTTRHKNSQTYKNREVQEAEVN

SEQ ID NO: 231 - protein, 301 aa, Corynebacterium glutamicum
MVTPIAVVGPTASGKSALGIALAHKLDGEVVNVDSMQLYKGMDIGTAKLTVEEREGIAHHQLDVWDVTETASVARFQSDAVADVEDIMSRGKTPILVGGSMLYVQSLVDDWQFPPTDSAVRARFEARLADIGVEALHAELTQLDPEAAAVIESNDPRRTVRALEVIELTGQPFQASQPPKDAPPRWGTRIIGLKTTPEWLNPRIEQRTARMFEQGFVAEVEHLVQQGLIADSTAGRAIGYSQVLAAMAGEMTWEDAFERTVTGTRRYVRRQRSWFNRDHRVSWVDASGDPTAQALEILGLQ

SEQ ID NO: 232 - protein, 303 aa, Fusobacterium nucleatum
MNILNKAIVIAGPTGVGKTKISIDLAKKLNAEIISSDSAQVYRGLNIGTAKIREEEKEGIKHHLIDIVEPVLKYSVGNFEKDVNKILNQNSEKNFLLVGGTGLYLNSVTNGLSILPEADKKTREYLTTLNNQALLELALKYDEEATKEIHPNNRVRLERVVEVFLLTGQKFSELSKKNIKNNNFKFLKIALERNRENLYDRINKRVDIMFAQGLVDEVKNLYKIYGDKLYSLNIIGYNEIIDYINAKISLDEAVYQIKLNSRHYAKRQFTWFKADKEYQWFNLDGISEQEIVKTIYTLFNIKA

SEQ ID NO: 233 - protein, 299 aa, Streptococcus pyogenes
MTKIKIVVIVGPTAVGKTALGISLAKAFNGEIISGDSQQVYRQLDIGTAKATQEEQEAAVHHLIDIREVTESYSAYDFVQDAQKAISDIVSRGKLPIIVGGTGLYLQSLLEGYHLGGQVDQEAVKAYRNELEQLDDHDLYERLQVNNITIEQVNRRRAIRALELAQFADELENAETAYEPLIIGLNDDRQVIYDRINQRVDRMLENGLLEEAKWLYEHYPTVQASRGIGYKELFPYFVGEMTLAEASDQLKQNTRRFAKRQLTWFRNRMAVSFTAITAPDYPQVVHDRVRDFLGQKEKS

SEQ ID NO: 234 - protein, 321 aa, Paracoccus zeaxanthinifaciens
MPVAFIAALNVAKGPQDQLSGRPMRIPDLTHIDASRHLLIVGPTASGKSALALAVAQAQGGLVVNADALQVWSCWRVLTARPSANDEAAAPHALYGHVTPGRSYSVGDWLREVGDLLGQRLIVVGGTGLYLTALTRGLAEIPATPDHVRRQADARIAAGELPAMIAELDAPTRAAIDLKNPVRVQRAWEVLTTTGRGIRDWQDATPPPLIAPQDCQRIQIVSDRDWLADRIADRFHLMLDQGALDEVRANLPIWDPAAQWAKAIGAPELVDHLQGRTSLSDAVQSAIVASRQYAKGQRAWFRGRMKDWDMWQAGHGGLHRA

SEQ ID NO: 235 - protein, 315 aa, Thermoanaerobacter tengcongensis
MAIQIVLIVGPTATGKSRLAVDVAKRFNGEVVSADSMQIYKYMDIGTAKITKEEMQGIPHHMIDIVEPNEEFSVAEYEKRAKAIIKDIHERGKLPIIVGGTGLYINSIVYIMHFSDFEGSKEFREKMKKLAETYGTSYLYEKLKEVDPEAARKIHPNDLRRIIRALEVYEFTGKPISHYQKMSGMRKNPEYDPIMIGLNYKNRQLLYEKINRRVDEMIKNNLVEEVVNLLKIGYNKYGTSMQALGYKEIVEYLNGEISLEEAVEKIKKGTRRYAKRQITWFKAYDFIKWFFVDDYKTYEELRENIFEYLAGKLKF

SEQ ID NO: 236 - protein, 312 aa, Streptomyces coelicolor
MSSAPPAPRVIAVVGPTAAGKSDLGVFLAQRLGGEVVNADSMQLYRGMDIGTAKLTPEERGGVPHHLLDIWDVTVTASVAEYQRLARERIDALLAEGRWPILVGGSGLYVRGAVDNLEFPGTDPGIRARLEEELELRGPGALHARLAVADPEAARAILPSNGRRIVRALEVIEITGRPFTANLPGHDSVYDTVQIGVDVARPELHERIALRVDRMWEAGLVDEVRALEAQGLREGRTASRALGYQQVLAALAGECTLDEARAETVRATKRFARRQDSWFRRDPRVHWLSGGVADRTELPRLALSLVERPVTA

SEQ ID NO: 237 - protein, 327 aa, Xanthomonas campestris
MAADQRPLAIAVMGPTASGKTALAIEAAQRWGGEIVSVDSALVYRGLDIGAAKPDAAMRAAVPHHLLDLRDPWQVYSAAEFAADARTAMAQIVARGKIPILAGGTGLYFRAALEGLAQMPEADPAVRLAIAAEAEQVGWGALHAQLARIDPVAAARIHATDRQRIQRALEVYRISGKPISYWQTRPAGPRAPVRVLKLVLAPRQRAVLHARIAMRLDVMLADGFLTEVEQLRALPQMRAVAAPLDLPAVRAVGYRQAWEYLDGAGSLAEFRDKAVQATRQLAKRQLTWLRGELDARWFDPERDRGQLEQAVAGFLGQRRTMQQPSAV

SEQ ID NO: 238 - protein, 327 aa, Xanthomonas axonopodis
MAVDQRPLAIAVMGPTASGKTALALEAAERWNGEIVSVDSALVYRGLEIGAAKPDAAMRAAVPHHLLDLRDPWQVYSAAEFAADARQAIAQIVARGRLPILAGGTGLYFRALLEGLSQLPEADQAVRASIAAEAQQIGWAGLHAQLARVDPVAAARIHATDPQRIQRALEVYRISGRPISAWQALPPGPRLPVRVLKVVLAPRERAVLHARIAHRLDAMLAQDFLTEVRRLRALPQLQAVAAPLDLPAVRAVGYRQAWQYLDGAGSLAEFRDKAIQATRQLAKRQLTWLRGELDARWFDPERDRHQLEDAIVGFLADRPAVRQASGV

SEQ ID NO: 239 - protein, 326 aa, Rickettsia conorii
MQSLYLIGDPKCCRNNSSKQKSIIILCGPTASGKSYLGHELAKAYNGEIINIDSMQVYKEIPIITASPPKSYKTEILYHLYNFLSMTEDFSVIKYLKLATEKIKEITDRGKLPILIGGTGLYINSLVFGYNNIPDISEDLQEQVRNLHVKIGNIELWSKLEKFDPLAASKINQNDTQRLIRAYEVFMQTGKSIFSFQTLPKEQILSDFNFKIIFLNPERKFLYKTCDERLDKIFKEGAIDEIALIKKQFAPKDYTNLKAVGIKEILAYLNGNLTLDEALNAAQIRTRQYAKRQVTWFKNQIQDKITLEYANQEEFTQTLKNPFKII

SEQ ID NO: 240 - protein, 316 aa, Pasteurella multocida
MPLTTPTAIFLMGPTASGKTDLAIQLRQTLPVEVISVDSALIYRGMDIGTAKPSAEELALAPHRLIDICDPAESYSAANFRQDALREMADIIAAGKIPLLVGGTMLYYKALLEGLSPLPSADEKVRSEIEEKAQLQGWAALHQELAKIDPLAAQRINPNDSQRINRALEVFYLTGKSLSELSQQKGDSLPYQILQFAIAPKDRSILHDRIALRFQKMIEQGFQQEVEKLYQREDLHLDLPAMRCVGYRQMWEYLRGDYDHDEMIFRGICATRQLAKRQITWLRGWKYPIEWLDSLAIESAKQTIIHAVTKISHSNS

SEQ ID NO: 241 - protein, 308 aa, Bacillus anthracis
MGEVQREKVAVIIGPTAVGKTKLSIDLAKALNGEIISGDSMQIYRTMDIGTAKVTKEEMDGIPHYMVDIKNPEESFSVAEFQERVRKHIREITERGKLPIIVGGTGLYIQSVLFDYQFTDDAGDAIYREQMEKLALERGVEYVHKKLQEVDPESAERIHANNVRRVIRALEIFHTSGEKMSDQLEKQENELLYDVSLIGLTMDREMLYDRINLRVDIMMDQGLLEEVEGLYNRGIRDCQSIQAIGYKEIYDYFEDRVSLEEAVSQLKTNSRRYAKRQLTWFRNKMDVTWFDVTDGEKTSEILRYIEGK

SEQ ID NO: 242 - protein, 463 aa, Arabidopsis thaliana
MVIGSGVFLTRTCYLRLQPPSLVLRRRFCAATTACSVPLNGNKKKKSEKEKVIVISGPTGAGKSRLAMELAKRLNGEIISADSVQVYKGLDVGSAKPSDSDRKVVPHHLIDILHPSQDYSLGQFYDDGRQATKDILNRGRVPIVTGGTGLYLRWFMYGKPDVPKPSPEVIAEAHDMLVGFQTEYNWDAAVELVVNAGDPKASSLPRNDWYRLRRSLEILKSTGSPPSSFRIPYDSFRVNLVAPDADDFLEDGSSADISIQNIETDLDYDFLCFFLSSPRVALYRSIDFRCEDMLSGPNGVLSEARWLLDLGLLPNSNPATRAIGYRQAMEYLLQCRRYEGESSPREFYAFLNKFQTASRNFAKRQMTWFRCEPMYHWLNASKPLDSILQCIYDAYESEAEMVEIPESLRMSKDVRDSREASELKGYRSKNRHFVRREDCSSVLEWIRSEGCKSEASCVESAIA

SEQ ID NO: 243 - protein, 329 aa, Arabidopsis thaliana
MKFSISSLKQVQPILCFKNKLSKVNVNSFLHPKEKVIFVMEATGSGKSRLAIDLATRFQGEIINSDKIQLYKGLDVLTNKVTPKECRGVPHHLLGVFDSEAGNLTATQYSRLASQAISKLSANNKLPIVAGGSKSYIEALVNHSSGFLLNNYDCCFIWVDVSLPVLNSFVSKRVDRMMEAGLLEEVREVFNPKANYSVGIRRAIGVPELHEYLRNESLVDRATKSKMLDVAVKNIKKNTEILACRQLKKIQRLHKKWKMSMHRVDATEVFLKRNVEEQDEAWENLVARPSERIVDKFYNNNNQLKNDDVEHCLAASYGGGSGSRAHNMI

SEQ ID NO: 244 - protein, 216 aa, Escherichia coli
IPLLVGGTMLYFKALLEGLSPLPSADPEVRARIEQQAAEQGWESLHRQLQEVDPVAAARIHPNDPQRLSRALEVFFISGKTLTELTQTSGDALPYQVHQFAIAPASRELLHQRIEQRFHQMLASGFEAEVRALFARGDLHTDLPSIRCVGYRQMWSYLEGEISYDEMVYRGVCATRQLAKRQITWLRGWEGVHWLDSEKPEQARDEVLQVVGAIAG

SEQ ID NO: 245 - protein, 329 aa, Chlorobium tepidum
MNTKPVLVILGPTASGKTELAFRIARQTGGEIISADSRQIYRGMDIGTAKPPRWMLDEVKHHFIDKKEIGEPFSAGDFAEQAAEKIRELHQRGITPVVAGGSTLYLEGLLKGFAELPPADPEIRAQLTRELERHGAEALYRRLEALDPEQAKTLDPTKTQRLIRSLEIIEISGTTVTALQSKTPGPPTGINFTVIGLDLPRELLYERINQRTSAMIQAGLEAEARYLFDKFRDEWRSKNLNALATVGYRELFEHFEELHDLDTAVSLIAQHTRNYAKRQLTFFRNRLDVEWVKAPLDEAEIEALVEFFSTRQDDSVPHSPIAIAKKQNA

SEQ ID NO: 246 - protein, 312 aa, Thermosynechococcus elongatus
MGDAGLIVIGGATATGKTALAIALAQQLNSVILSADSRQVYRGFDIGTAKPTPAQQQQVRHHLIDICDPRETLTLAIYQAKAQALIAHYHAQGITPLLVGGTGLYIRSITQGLTMPQVPPQPHLRAQLMALGQQECYQWLQQVDPVAAQRIHAHDQVRTLRALEVYYTTGVPLSQQQRREPPPYRIWYFALTGGDRQQERCRIEARTQEMLAMGWLDEIQQLQRQYGEDLPLLDTLGYREMRQYLRGEVTLAEAIALTVQHTQQFAKRQRTWFRAEPDIHWLQATTLEAQLAEIQAQFTLCPKTTATKRRMS

SEQ ID NO: 247 - protein, 459 aa, Arabidopsis thaliana
MVIGSGVFLTRTCYLRLQPPSLVLRRRFCAATTACSVPLNGNKKKKSEKEKVIVISGPTGAGKSRLAMELAKRLNGEIISADSVQVYKGLDVGSAKPSDSDRKVVPHHLIDILHPSQDYSVGQFYDDGRQATKDILNRGRVPIVTGGTGLYLRWFMYGKPDVPKPSPEVIAEAHDMLVGFQTEYNWDAAVELVVNAGDPKASSLPRNDWYRLRRSLEILKSTGSPPSSFRIPYDSFRVNLVAPDADDFLEDGSSADISIQNIETDLDYDFLCFFLSSPRVALYRSIDFRCEDMLSGPNGVLSEARWLLDLGLLPNSNPATRAIGYRQAMEYLLQCRRYEGESSPREFYAFLNKFQTASRNFAKRQMTWFRCEPMYHWLNASKPLDSILQCIYDAYESEAEMVEIPESLRMSKDVRDSREASELKGYRSKNRREDCSSVLEWIRSEGCKSEASCVESAIA

SEQ ID NO: 248 - protein, 296 aa, Streptococcus agalactiae
MRKIKLIAVVGPTAVGKTALGIELAKTFNGEIISGDSQQVYQKLDIGTAKASKEEQEQAYHHLIDVREVNENYSVYDFVKEAKVAIDTIISKGKIPIIVGGTGLYLQSLFEGYHLGGEVNQETLMAYREKLESLSDEDLFEKLTEQSIIIPQVNRRRAIRALELAKFGNDLQNSESPYDVLLIGLNDDRQVLYDRINRRVDLMMDNGLLDEAKWLYDNYPSVQASKGIGYKELFPYFSKQIPLEEAVDKLKQNTRRFAKRQLTWFRNRMNVEFIMVGEENYQQKIKRKVSDFLSSK

SEQ ID NO: 249 - protein, 328 aa, Rhodobacter sphaeroides
MSENDPGFNRDRPPVAEEPQRSPAPTSPFAFTVPSNSLSELPDIPPDRPVLIAGPTASGKSALAARLVEDGGGAVVNADALQVYDCWRLLSARPSAAEEAALPHRLYGHVGARQTYSAGHWLKEVAGVLAEGLRPVIVGGTGLYFSALTGGLAEIPHTPPEVRAAADARLAEAGLARMVAELDAETAARIDLQNPARVQRAWEVLRATGRGLARWQAETAPPLLPLSDATALVIRPDPAWLAQRIDSRFDLMMADGALDEVRAALPDWDPTLPSARAIGAPELVAHLRGEIPLDEAVAAAKLASRQYAKRQRTWFRNRMRLWHEIRLP

SEQ ID NO: 250 - protein, 468 aa, Rhodopseudomonas palustris
MIRVSSTWPITSSGRPLSSATRSRSAGSNSISPRIARSVIAATWSFSPTKPASSSMHSWPIMVESISARKSFLRRVAAGCTTTSTGRSPRAARSRSASTRGSSVLAKKMSAAISSCSQTASLGWGRTARAPSITVESSAGLFGLQMSVATSDMTAEGPERHGRRPAAVLIAGPTASGKSALALKLAQASGGTVINTDSMQVYRDLRIITARPTPDEEALAPHRLYGTVDAAVNFSAGAYVEAAAAALAEVRAAGRLPILIGGTGLYFKALTRGLSAVPPVPAEVRDAVRLRLDRDGVQALHAELARQDPEAAARLAPADRTRIARALEVVLATGRPLADWHQQTSPPLLPPDDVVAVFLAPDREALYARIDSRFAAMLQGGALDEVAALAERQLDPLLPAMKAHGVPALIRHLRGEITLEEAASIGAADTRHYAKRQFTWFRHQLPEFKWVRPEEADAFLNTVIPGRA

SEQ ID NO: 251 - protein, 136 aa, Rhodospirillum rubrum
MIDPLASPGSAPLIVIAGPTASGKSALALRVARRFNGVVINADSMQVYRDLRILSARPSVEDEAAAPHALYGVLDGAEVCSVGRWLALADGAVAAARAAGRLPILCGGTGLYLKAALEGLASVPEVAPEVRAEARE

SEQ ID NO: 252 - protein, 218 aa, Chloroflexus aurantiacus
MSADSRQIYRWMDIGTAKPSPEEQAQAPHHLIDIRDPDQPFSLAEFCDLATAAIADIRGRGRIPLLVGGTGQYLAAFLEGWQVPRVAPQPDLRAELELIAAREGPAVLHARLAAVDPVAASRIPPTNVRRVVRALEVYLVSGEPISRLQERKEPPFRPRTIWLHRPRAELYARADARIERMIAAVWSRKLRSAGPWLRLVASGNVESRLYSVSTIFYR

SEQ ID NO: 253 - protein, 315 aa, Ralstonia metallidurans
MSVQSHPPVVCLLGPTASGKTAAALELAARTPVEIISLDSALVYREMDIGTAKPTHEELASVPHHLIDIIDPLESYSAAQFMTDAERLIGEIRARGRTPLIVGGTMLYYKALTQGLNDLPQADATVRAELDALAAERGWPALHAMLAEVDPITAARLAPNDAQRIQRALEIHRLSGQPMSALLARQADARTFTGAADARYRVIALEPSDRAVLHARIADRYDAMLKGGLIEEVERLRARGDLHLGLPSIRCVGYRQVWEYLDGDCDFATMRERGIAATRQLCKRQLTWLRSTPERIGIDCLAPDYVARVADAAGW

SEQ ID NO: 254 - protein, 315 aa, Burkholderia fungorum
MTSRTPTTVPCLLGPTASGKTAAALALAARHPVEIISVDSALVYREMDIGTAKPTAEERAVAPHHLIDIVDPTDSYSAAQFRADTLRLTGEIHARGRLPLLVGGTMLYYKALTQGLNDLPAADADLRATLDADAAREGWPAMHARLAAVDPVTAARLAPNDSQRIQRALEVFMLTGQAMSALLAAPARVDDAAAAWRFVPVALEPSDRGVLHARIEKRFDAMLANGFVDEVVKLRERGDLSPEMPSMRCVGYRQVWEYLDGAVDYSTMRDKGVFATRQLCKRQLTWLRSMTERVVVDCCDPHATARVLEAIEALL

SEQ ID NO: 255 - protein, 305 aa, Enterococcus faecium
MEKVLVIVGPTAVGKTALSVELAQLFGGEIISGDSLQIYKNLDIGTAKIKEEEMNNVPHHLIDVIEPTQRYSAADFQHSGRQLITEIANRGHLPIIAGGTGLYIQSLLYDYQLGATEEANPEIRKKYETLAETIGSQALWNQLKEKDPAAAEKIHWNNQRKVIRALEVLETTGHSITAPKEEPKQLYDYLMIGLDTKRSILYERINQRVDLMLAEGLVAEARKVYELGEVQASQGIGYKEFFPYFEGKETLEEATEQVKLHSRRYAKRQLTWFRNRLDAQWFDLISEPNQKSQIEQTIKKWLEAE

SEQ ID NO: 256 - protein, 317 aa, Xylella fastidiosa
MPADTRPAAIVLMGPTASGKSQLAIDIAKRWGGEVISVDSVLVYRGLDIGTAKPNAAMRASVPHHLIDICEPWETYSAADFAHDARAAIDMIVRRGALPILTGGTGLYFRALLAGLSDMPPAHPEIRAMIAAEAKRDSWATLHTRLAEVDAITAARIHATDPQRIQRALEVYLVSGRSMSDWQNQPPKQRLPLRVLKLVLAPTHRKVLHFRIAQRFKAMLDNGLLAEVNALRTHPSIHAMARPLDLPAMRAVGYRQCWEHLDGMYTAEMLYQRSVAATRQLAKRQLTWLRGELDALWFDPEHDQSRIEKVMEAFLNR

SEQ ID NO: 257 - protein, 317 aa, Xylella fastidiosa
MPADTRPAAIVLMGPTASGKSQLAIDIAKRWGGEVISVDSVLVYRGLDIGTAKPNAAMRASVPHHLIDICEPWETYSAANFAHDARAAIDMIVRRGALPILTGGTGLYFRALLAGLSDMPPAHPEIRAMIAAEAKRDSWATLHTRLAEVDAITAARIHATDPQRIQRALEVYLVSGRSMSDWQNQPPKQRLPLRVLKLVLAPTHRKVLHFRIAQRFKAMLDNGLLAEVNALRTHPSIHAMARPLDLPAMRAVGYRQCWEHLDGMYTAEMLYQRSVAATRQLAKRQLTWLRGELDALWFDPEHDQSRIEKVMEAFLNR

SEQ ID NO: 258 - protein, 336 aa, Magnetococcus sp.
MTSAIRFSSNMVDPSSLHSHDPGAIPVLFIMGPTASGKTGLALHLAEHFPLEIVNADSVQVYRGMDIGSAKPTLQERQAIVHHLIDVTTPDDPFSAGRFRTAALEVIEDCHRRGVIPALVGGTGFYFRAVEQGIAEIPEVDAQIVAELNRRVCDEVGLACCYAQLQQVDPPWAARVEPGDRQRIVRGLSVYLASGQPLSYWQQLSCQQAPEGPALRICKLAIEWPREQLYARINQRFEQMLKEGFMEEVQGLLSRGYHGDLPAMRAVGYRALIGYLQGAYDLARAVELGQRDSRRYAKRQITWLKAEPGLQWLAPEGAKQAALDEVRAFLQFFKKK

SEQ ID NO: 259 - protein, 306 aa, Lactobacillus gasseri
MQKIIVLIGPTGIGKTELALKLAPKINAEIISGDSMQIYQEVSIGTAKPTAEELRQVKHYLVNQRSIFDEYSVKDFVAEGKKAVNQIAAKGSIPLVVGGTGFYINALVNKLQLGEPGDYQTSVDSKWEKYLKDNGAEKLWQLLDEKDPVAAKKIAPQNSRRTLRALTVISRTGKLFSQQQAQISPRYDALIIGLNSNREEVYQRINKRVDKMMNAGLLKEAKFVYDNRAREHQAIQAIGYKEFFPYFSGEKTLDECVNKLKQASRKYAKRQLTYFKHQLSVVWLDPLQDKEVSERALNEIKSFLNK

SEQ ID NO: 260 - protein, 317 aa, Magnetospirillum magnetotacticum
MTIPLAPRPAIVIAGPTASGKSGLALAIAREFGGVVINADSMQVTDALPLLTARPSPEDMVRAPHRLYAVLPPSELCSAARWALMATGEIQAAWNEGKLPILTGGTGLYLKAVMEGLSPIPDIPESIRAEARALLAEMGNAAFHNRLAKHDPLMAERLDSGNSQRLARAWEVIMATGRSLAEWQDEPRQGAVAARWFTMVLDPPRPRLYAQCESRFRAMVAAGALDEVRAFEALGLAHDLPIQKALGRRELAAHLAGETGLDAAIADACQATRNYAKRQGTWFRHQMMASLTVSEQLSESLIATIFLKIRQHLLTAP

SEQ ID NO: 261 - protein, 319 aa, Thermobifida fusca
MSTVIAVVGPTAVGKSDLSVALALRLTEHGLPAEIINADSMQLYQGMDIGTAKLTPEERRGVPHHLLDVWEVTQTANVADYQRMARAVIDDLHAAGRVPVLVGGSGLYVRAALDELDFPGTDPKVRARLEAELAEQGPLALHARLARLDPEAARAILPTNGRRIVRALEVIEITGGPFTATLPDHVSRYPCVQIGLTAPRPELDERIALRVDRMWEAGLVDEVRALEKAGLRDGFTASRALGYAQILRFLAGECTEEEAKEETVRATRRFARRQESWFRRDPRVHWLPYDAPDLVDRAFALVCEHSDLCFRSATRDEQS

SEQ ID NO: 262 - protein, 297 aa, Leuconostoc mesenteroides
MNKIVVLTGPTASGKSSLSIQMAQRLNGEIVSADSMQIYRNLDVGTAKVTKEEQNIVPHHLIDIVDLTANYSVGDFIIAADKVIADIISRGKLPIIVGGTGLYVKALLGFQELEYAASDTEEVHKLNAYELDKLVVELKSLDINRAQKVDLKNKQRVIRAIQIAKYGKKDAKLTQRPKYDALVIGLDWPRELLYERINHRVTQMVQDGVLKEAQTILDAGGEKLQSGKAIGYKEFFPYLRDQVTLDKAINQLQQDSRRYAKRQLTYLRHQIPGLVWLKGQTAELRLTEMIEGWLSLK

SEQ ID NO: 263 - protein, 281 aa, Microbulbifer degradans
MVYRDMNIGTAKPTASELALAPHRLIDIRDPAEAYSVADFCRDAKAEIESIHSQGKIPVLAGGTMMYFKALLEGLSDMPASDPAVRAQIDKRASEEGWPALHSELASVDPETAANIHPNHSHRISRALEVYVISGKRMSAWRGQANNGLIDTYDWVQICVAPRERTLLHQRIAQRFDMMLEQGFIDEVRALYSRNDLNVDMPSIRAVGYRQAWDYLAGVSSYDEMREKGIAATRQLAKRQFTWLRSWQGLEWIYTQDEDANLLSSEEIVNKALNYLAKRTI

SEQ ID NO: 264 - protein, 257 aa, Oenococcus oeni
MSDPHLKEKVVVIAGPTASGKSDLAIKIAQMIDSEIISEDAFQIYRGLDIGTAKPSKDDLAKVKHHFIDIKEVDESYSAYEFARDARIVINQISSKKKIPLIVGGSGFFLQTLLGDRRISDKDNPIVPKKAGIENRLYNALLIGLNTERSQLYDRINQRVERMFEKGIVKEAENLFRQQGNFQSKKAIGYREFAGYFANQYDLSEVETLIKRDSRRYAKRQLTYFKNQFPDMRWFDTKQITENPKLIIDLVKKFNQF

SEQ ID NO: 265 - protein, 218 aa, Trichodesmium erythraeum
MVLPTLLVGGTGLYIKAIVKGLKIPRVGPNEKLRSQLANLGQKQCYKMLQQVDQVAVEKIHPNDVVRTLRALEVFYVSGKPISQQQGEDLPNYPILQIGLDCDVEVLGERIRDRTEKMVEVGLVEEVKCLCEKYGEKLPLLNTLGYAEMKQYLAGDISLAEAIKATVLHTRQFAKRQRTWFRGYPEIEWFDGNAPNLLDKVWERVREFTRILAEKTQE

SEQ ID NO: 266 - protein, 309 aa, Geobacter metallireducens
MKEEEKTRLVIVQGPTASGKSALALELAERIGGEIVNADSMQVYRGMDIGTAKPSQEERRRVPHHLYDIVDPKVNFTAADFREHASRAIADIERRGKRVILVGGTGLYIRILTQGLVASPGGDDNIRRELEDQAHGEGLESLHRRLAAVDPVAAARLHPNDGVRIVRALEVFLLTGRPLSAFQEAHRFADEPYRCLKLGITVERELLYRRVEERVDRMIAEGLVEEVRGLLSAGYPATLKAMGSIGYREICAHLAGEFSLDEAMRLIKQNTRQYAKRQMTWFRRDSEIIWVEYPGKFDSILSTVMGFYH

SEQ ID NO: 267 - protein, 348 aa, Pseudomonas fluorescens
MQPWPTDLDPTGPGRSGQTVPARSLMSQLPPAIFLMGPTAAGKTDLAIELTKVLPCELISVDSALVYRGMDIGTAKPSKELLAEFPHRLIDILDPAEAYSAADFRRDALEAMAEITARGKIPLLVGGTMLYYKALIEGLADMPAADPEVRAQIEEEAARLGWQALHDQLAAIDPESAARIHPNDPQRLSRALEVYRVSGQSMTELRLKQSVQSTEAAASGLQQLPYTVANLAIAPTNRQVLHERIKQRFTNMLEQGFIDEVVALRNRSDLHAGLPSIRAVGYRQVWDFLDGKLTSAEMQERGIIATRQLAKRQFTWLRSWKDLHWLDSLDCDNLPRALKYLGTISILS

SEQ ID NO: 268 - protein, 111 aa, Pseudomonas fluorescens
MVIALITGVTPMSDQVIPRYLPIDTYDAESPVLFINTQKELSDMAACAMHRFVVVRDLADTFSSLDLKGISDCDLTRITSAVHLLMREGCAILNVIQTRALQREEGFKTAL

SEQ ID NO: 269 - protein, 313 aa, Oceanobacillus iheyensis
MKETVISIVGPTAVGKSLLGIEMAKRFNGEVISGDSTQVYKGMDIGTAKVTKEEMDGIMHHMIDIISPDESFSVADFQLHAKKCIDDVLGRGKLPILVGGSGLYIQAVLYNYNFSEQRRDESFTKKLEEIIEEEGPNQLYTRLKEVDPVQAAKVHPNNHRRLIRALEVYETTGMTMTEYQQQQQLESPYHLILIGLDMDRDVLYDRINQRVDHMIDTGLIEEVRDLIDRGYENCQSMHAIGYKEIIQHISGNQPMEYAIDALKQHSRKYAKRQLTWFRNKMNVQWYKMEPSIIDEKIEFILNDLAGILEEKSN

SEQ ID NO: 270 - protein, 371 aa, Azotobacter vinelandii
MGGRPGRNWVWPTSTSCSCAAVDRTRPLAARCPASETMPPFVFVPSPPMSHLPPAIFLMGPTASGKTDLALELARVLPCELISVDSALVYRGMDIGTAKPAKALLAEFPHRLIDIRDPAESYSAAEFRDDALAAMAEISARGRIPLLVGGTMLYYKALLEGLADMPSADPALRAELEARGAAEGWAALHRELATVDPESAARIHPNDPQRLVRALEVYRVSGLSMTAHRLRQVAQNPLSDRSAGEHLPYTVVHLAIAPTQRQILHERIARRFRLMLEQGFVDEVELLWRRGDLHASLPSMRAVGYRQVWEYLDGLLTREQMVERGIIATRQLAKRQFTWLRNWTDLHWLDSLGDDNLQRTLKYLETAAILA

SEQ ID NO: 271 - protein, 479 aa, Novosphingobium aromaticivorans
MRAPGMGRMRSSRHWAMAASGRSFSSPTRSRNADSKSSSPCIARSVIAAMRSLRPAKSASSSMHSWPIMVESMSDTNRWGTSISPLESSRSLSGKHWSSIWRIPTGLPSTTSSSSTSEQNSSIPAPATSQSRASIISMASARLSPSVSGSAIRRAMITGNSFLDDNVKAAAERPRLALIAGPTASGKSDLAVNLALRAMDRGQDAVIVNADSAQVYADLRVLSARPSDEEMRGVPHVLFGAWDGARACSAADWAAAARREIAAAHQRGALPILVGGTGLYIRTLLDGIAPVPEIDPQVREEVRAMPLEAAYAELEKSDPERARKLAPADAQRITRALEVMRSTGRPLAYWQQQLSGGIGNDVALAPLILLPERQWLYRRCDLRFELMWDGGALEEVEALLARDLPDSLPVMRAIGVPEIAAFLRGDLSRDAAIASGQQATRNYAKRQYTWLRHQNPGDWPRMEYDNSIDSAKIASLLRL

SEQ ID NO: 272 - protein, 313 aa, Desulfitobacterium hafniense
MKPLIIIVGPTAVGKTALGVALAQALQGEIISGDSVQVYRKLDIGSAKPTLAEQGNVPHYLLDALDPAEPFTVAQFQTLANQSIQNIQSRGKVPIVVGGTGLYIRSLIDPFQFAEHGSESIRSFWTAFLSEQGKEALHRELAKRDPLSAQRLHPNDTVRIIRALEMCQLTGKPFSEIRGNQDMNYPPLPPSLLYVGLTAPREIIYERINRRCEQMVAAGLIEETHNLIKEGYSPKLKPLQSIGYRHALLYLYGKVTLPEMMRIFQRDTRHFAKRQLTWFRRDPRVVWYDTYSGNLTNILESLIGTCSGMESRV

SEQ ID NO: 273 - protein, 302 aa, Nostoc punctiforme
MTKLIVICGATATGKSSLALALAMRLGSVIISADSRQVYRKFDIGTAKPTVAEQKLVPHYLIDICDPTDTMTVADYQEQTQALIASVDVTPLLLVGGTGLYIRSIVQGMKIPRVAPQIELRSQLESLGQLQLYAMLQQVDPVAAQKIHANDSVRTLRALEVYYVTGCPISEQQGENPPNYPILQIGLDCDVEKLGNRIKQRTEQMIADGLVAEVEYLCQKYGADLSLLNTLGYQEIKQYLAGDISLDEAKELTILHTRQFAKRQRTWFRAYPQIEWFDANNPDLLDKIWLRINEFTNCTHSS

SEQ ID NO: 274 - protein, 304 aa, Cytophaga hutchinsonii
MSFINKYVIVVVGPTAAGKTALAVSLAKRFNTAVLSADSRQVFKELSIGTAKATMEEQDGVPHYFVDSISIEESFNAGMFEREGLQLLDTLFLKHDVVIVCGGTGLYVKALLEGMDALPQADPELREALNREFEQRGLEVMTGELKEIDPETHAVIDLKNPLRVFRAIEVYRQTGKPLSSFKTGAKQERPFKTIRIGLNMPREELYARIDRRMDRMLEAGLEKEARDNIQYRNYNALQTVGYSEIFGFIDGLYDREEMIRLLKRNSRRYAKRQLTWFSKDAEVKWFHPGEITEITTFIEAKLQE

SEQ ID NO: 275 - protein, 328 aa, Bifidobacterium longum
MTQRVVSIVGPTASGKTGLGIAIARRLAEAGERAEIVNADAYQMYRGMDIGTAKPTAEEQAAVPHHLIDIIDPEDTMSVARFQQLARETIADLQSRGIRPILVGGSGLYARAAIDDITFPGTDPDVRTRLEEREKTEGAGALFDELRAKDPEAAARMDPRNPRRTIRALEVIELTGKPYSASLPRYRYVIPSVQIGLDLDRPDLDHRIDLRTKQMYDDGFIEEVERLRPHLGATAVRALGYQQIIDLLDGIWDVNDAFADIAQKTKRLARKQMGWFGRDPRIHWLQALNPKLVDNAMAIIAHADAGDYDPIDARADEYTQHHLGDITA

SEQ ID NO: 276 - protein, 311 aa, Haemophilus somnus
MNKKSTAIFLMGPTASGKTDLAIQLHQELPVEVISVDSALIYKGMDIGTAKPNAQELALTPHRLIDIKDPSENYSAAEFRHDALQEMQKITQQGKIPLLVGGTMLYYKALLEGLSPLPSADEKVRLEIEQKAEKFGWATLHNELAKIDPISAQRINPNDSQRINRALEVFYLTGQSLTELTAQKGKEIPYHIIQFAIAPDRAVLHQRIEQRFHKMIEQGFQQEVEKLYQRSDLHPNLPSIRCVGYRQMWEYLQGNYDKDEMIFRGICATRQLAKRQLTWLRGWKSPIEWLDSLNPKSTKEKIIKTIKHNCK

SEQ ID NO: 277 - protein, 323 aa, Pseudomonas syringae
MNALPPAIFLMGPTAAGKTDLAIELTKVLPCELISVDSALVYRGMDIGTAKPSKTQLAEHPHRLIDILDPAQSYSAADFRSDALAAMAEITARGNIPLLVGGTMLYFKALLDGLADMPAADAQVRAQLEADAQAFGWQALHDQLAVVDPVSAARIHPNDPQRLIRALEVYRVSGMSMTAHREQQTAQSTEAAASGRQQLPYTVANLAIAPADRKVLHQRIALRFEQMLDQGFLDEVLALRSRGDLHSGLPSIRAVGYRQVWDHLDGKLTRDEMQERGIIATRQLAKRQFTWLRSWDDLHWLDSLASDNLSRALKYLGSVSILS

SEQ ID NO: 278 - protein, 312 aa, Desulfovibrio desulfuricans
MRMSEASVIPVVCIVGPTGAGKTAASLHLAAVFDGAVINCDSRQVYKDFPVITAQPTLEEQASCPHHLYGFMGIQEKMSAGVFLDMACPIIKEEHAHGRLPLLVGGTGLYLRALLDGIAAIPDIPETVSQKWQERCAARGAPALHRLLEAQDPQTAERLHPNDSQRIVRALEVQEATGRPLSWWHAQPVPPSPYRAVKIGVSATLDGLTPRLAKRIEMMLAAGALDEARNAMGICDNPRAPGWSGIGCAELYSYIKGAVSLDECKRLWLHNTRQYAKRQLTWFRREPNLHWLDGTDMAAMERLVHSVAGSTG

SEQ ID NO: 279 - protein, 310 aa, Brucella suis
MSEDAVKNAILIAGPTASGKSALAIRMAKATGGFIVNTDSMQVYGVLDLLTARPSRADLAEAEHFLYGHVPPSSTYSTGKWFEDVEALLGRCGLQGRVPIFVGGTGLYFRALLGGLSQMPEVSAQVRDHWRGRMEAEGAKALHAVLCVRDPAIAAALQPSDSQRIVRALEVLESTGKSLLEWQKVKGRALVDDQSAQKIVLRPDRAWLGERIARRFSAMWAEGAIDEVRALLALDLDPALPAMKAIGVREVSAFLAETMSREEAIERSVIATRQYAKRQSTWFRNQLGEDWRVYASGEEVFQGGSFRDPQ

SEQ ID NO: 280 - protein, 316 aa, Shigella flexneri
MSDISKASLPKAIFLMGPTASGKTALAIELRKILPVELISVDSVLIYKGMDIGTAKPNAEELLAAPHRLLDIRDPSQAYSAADFRRDALAEMADITAAGRIPLLVGGTMLYFKALLEGLSPLPSADPEVRARIEQQAAEQGWESLHRQLQEVDPVAAARIHPNDPQRLSRALEVFFISGKTLTELTQTSGDALPYQVHQFAIAPASRELLHQRIEQRFHQMLASGFEAEVRALFARGDLHTDLPSIRCVGYRQMWSYLEGEISYDEMVYRGVCATRQLAKRQITWLRGWEGVHWLDSEKPEQARDEVLQVVGAIAG

SEQ ID NO: 281 - protein, 297 aa, Leptospira interrogans
MTFPILILAAPTGAGKTSLITELDPTRFEILSFDSRQIYREMPIGTAAPTKEQQSKIRHHLVEVLSPKESIDAGLYNRMAEEALQKVLNTDKIPVFTAGTGFYLKAFLFGMFPVPEISVSVRERVLSMSIEEKKVLLNDLDPEALDKIFSGDDYRLGRALEVNLMGEKWSRLKIDPNTSAIYKYNLEIRLGIFLDLDRKELYERINLRAKRMIDLGMADEAWEIRERYGESCPGLKSLGYNFALENKKGNSNVETFLVDLSQSHRNYAKRQITWFRKENYIQAMDRSEALERIKHIK

SEQ ID NO: 282 - protein, 308 aa, Shewanella oneidensis
MNKELQPKVVFLMGPTASGKTALALELAEKHNCEIISVDSALIYRGMDIGSAKPSAEELARGPHRLIDIRDPSESYSAADFRADALSEIEQIISMGKTPLLVGGTMMYFKALLEGLSPLPSADEVIRADIQAEADANGWEALHDQLREIDPVSAERIHPNDPQRLSRALEVYRISGKSLTELTMTKSAPLPYNVVQFAIAPRERKVLHELIGQRFRIMLEQGFIDEVAQLKARDDLHLDLPSMRCVGYRQCWQYLDGEFDHDTMVEKAIAATRQLAKRQLTWLRSWPELNWLESGAEGNLVTLMRHCR

SEQ ID NO: 283 - protein, 294 aa, Streptococcus mutans
MKTKLIVVLGPTAVGKTALGIKLAQQFHGEIISGDSQQVYRKLDIGTAKATAAEQAAVPHHLIDVREVDENYSAFDFVQEATKEIANICARGYLPIIVGGTGLYLQSLLEGYHLGGQVDHEAVLAYRRELETLSDTELSQLVETKQIVMTEPNRRRLMRSLELHKFSQGVQNQGSPYDVLLIGLNDNRQDLYERINARVDKMMAAGLLDEAKWLYDNYPHAQATRGIGYKELFPYFAGDIGLEEAVEKIKQNTRRFAKRQLTWFKNRMAVSFYSVSDSDYKGKINQAVVDFLRN

SEQ ID NO: 284 - protein, 236 aa, Pantoea agglomerans
MRGNVYLLWGATTTGKTAFSVSVAKERGWSVIALDRFQGYHEISTGSGAPTNNELEKTERIYITPQRGLADGIITAKDYNYWLKSRVLSLPEGKSDFIIEGGSVSLLKEMVSDEFWADFLWEIKIFRAPSKDVFIKRAKRRITDMLHPEDGRPSIMDEVSSFFMNHKTIHPLEDIDGYRTIIDYCRCKKIGFDKLKIMTTDQEKIIISGIAEEYYAHALWQEQETPCFPHSWSRRW

SEQ ID NO: 285 - protein, 296 aa, Streptococcus agalactiae
MRKIKLIAVVGPTAVGKTALGIELAKTFNGEIISGDSQQVYQKLDIGTAKASKEEQEQAYHHLIDVREVNENYSVYDFVKEAKVAIDTIISKGKIPIIVGGTGLYLQSLFEGYHLGGEVNQETLKAYREKLESLSDEDLFEKLTEQSIVIPQVNRRRAIRALELAKFGNDLQNSESPYDVLLIGLNDDRQVLYDRINRRVDLMIDNGLLDEAKWLYDNYPSVQASRGIGYKELFPYFSKQIPLEEAVDKLKQNTRRFAKRQLTWFRNRMNVEFIMVGEENYQQKIKRKVSDFLSSK

SEQ ID NO: 286 - protein, 301 aa, Corynebacterium efficiens
MITPIAVVGPTASGKSALGIELALRLDGEVVNVDSMQLYRGMDIGTAKLTPEERQGIPHHQLDVLDVTETASVARYQQEAVADVEEIMSRGKTPILVGGSMLYVQSLVDDWQFPPTDPAVRARWEARLAEIGVTRLHEELRARDPEAAAIIENNDPRRTVRALEVIELTGQPFKASQPPKDAPPRWGTTILGLRTTADWLNPRIELRTHLMFERGFLEEVEGLVRDHGLIAESTAGRAIGYAQVLDALAGELTLDEAVERTITGTRRYVRRQRAWFNRDHRIRWIDADGDTTARALDILGR

SEQ ID NO: 287 - protein, 316 aa, Escherichia coli
MSDISKASLPKAIFLMGPTASGKTALAIELRKILPVELISVDSALIYKGMDIGTAKPNAEELLAAPHRLLNIRDPSQAYSAADFRRDALAEMADITAAGRIPLLVGGTMLYFKALLEGLSPLPSADPEVRARIEQQAAEQGWESLHRQLQEIDPVAAARIHPNDPQRLSRALEVFFISGKTLTELTQTSGDALPYQVHQFAIAPASRELLHQRIEQRFHQMLASGFEAEVRALFARGDLHTDLPSIRCVGYRQMWSYLEGEISYDEMVYRGVCATRQLAKRQITWLRGWEGVHWLDSEKPEQARDEVLQVVGAIAG

SEQ ID NO: 288 - protein, 299 aa, Mycoplasma penetrans
MKKKLIIVVGPTASGKSDLTFKLAQDLKSEIIVCDAYQVYKEISKGINKPEIENLNAIKHHFVNHVSINEVWHIKRFKEEIEELINSNMDKNFILEGGSNLYIDCLINNYQLNELDLTLDYSNLSNDELYEKLQKLDFEESLKISKNNKKRLIQALRIIESNNNTKKSVLDKNNKEPLYDFFLIRMIIDRDILYKKINDRADKMFKNNWREEVEQLIKANGNSMMNTNALKALGYDEIYNSIIENRETNLDLIKQKTRNYAKRQETWIRNKFKIDFNFSNYDQYNELLDKCKAFLNDKK

SEQ ID NO: 289 - protein, 323 aa, Pseudomonas putida
MSGKPPAIFLMGPTAAGKTDLAIELTTVLPCELISVDSALVYRGMDIGSAKPSKEVLAAHPHRLIDILDPAQSYSAAQFRADALEAMAEITARGKIPLLVGGTMLYYKALIDGLADMPAADATVRAELEAQAEALGLAELHRQLAEVDPESAARIHPNDPQRLIRALEVYRVSGESMTAHRRRQFAESRGADAGAGGHLPYTVASLAIAPTDRHILHQRIALRFSQMLEQGFVDEVRSLRARSDLHAGLPSIRAVGYRQVWDYLDGKLTENEMRERGIIATRQLAKRQFTWLRGWPEVHWLDSLACDNLSRTLKYLGAISILS

SEQ ID NO: 290 - protein, 257 aa, Heliobacillus mobilis
MLVVGPTAVGKSDIGIAIAQHFNGEIISGDSMQVYRGMDIGSAKIPPEQRGGIPHHMIDIIDPDEPFSVADFQRRVTDLIPQIVARGRLPIMVGGTGLYVRSITDHYKFSEEAKDLELRARLETKAAELGPEAFHRLLAEIDPDAAKRIHFNDRKRIIRAMEVYHLTGKRQGEFHYAASVQKPKYRLAPIALTMDRQELYRRIDQRAQIMIELGLVEEVKGLLERGYDPALPSMQGLGYKEIVNISGVNITFPRPYL

SEQ ID NO: 291 - protein, 304 aa, Vibrio vulnificus
MGPTASGKTELAIRLRQRYPVELISVDSALIYKGMDIGTAKPDEREQQLAPHRLIDILDPTEAYSAADFRRDALAAMNEIVAQGKIPLLVGGTMLYFKALLEGLSPLPAANAEIRQQIEQEALTKGWSVLHDELQEIDPVSAARIHPNDPQRLSRALEVYRISGKTLTELTETKGESLPFRVKQFAIAPKERAELHRRIELRFDKMMEAGFEQEMRALYTRKDLHPDLPSIRCVGYRQMWDYLDGNCTLDEAIYRGICATRQLAKRQITWLRSWDNLTWLDSENIEQSLETLSEAIASDRDSCV

SEQ ID NO: 292 - protein, 318 aa, Bradyrhizobium japonicum
MSEGQVGRRPIGKAVLIAGPTASGKSALALELALAAGGVVINADSMQVYRDLRIITARPTRADEALVPHHLYGHVDAAVNFSAGAWVSDAAKALEGARAEGRLPIFIGGTGLYFKALTAGLSVVPPIPAEVREDVRARLERNGVEALHAELAARDPRAAGRLNLRDRTRIARALEVIEATGRSLLDWHQEGQPPLLPRDSFHAVFLAPGRDELYARIDARFDAMLGAGALREVERLAARQLDPLLPAMKAHGVPALIRHLRGELSLDEAATIGRADTRHYAKRQFTWFRHQLPEFEWVKPEEARGWLAAIVNAAQDEG

SEQ ID NO: 293 - protein, 332 aa, Staphylococcus epidermidis
MTEMTKPFLIVIVGPTASGKTELSIEVAKKFNGEIISGDSMQVYQGMDIGTAKVTTEEMEGIPHYMIDILPPDASFSAYEFKKRAEKYIKDITRRGKVPIIAGGTGLYIQSLLYNYAFEDESISEDKMKQVKLKLKELEHLNNNKLHEYLASFDKESAKDIHPNNRKRVLRAIEYYLKTKKLLSSRKKVQQFTENYDTLLIGIEMSRETLYLRINKRVDIMLGHGLFNEVQHLVEQGFEASQSMQAIGYKELVPVIKGNISMENAVEKLKQHSRQYAKRQLTWFKNKMNVHWLNKERMSLQMMLDEITTQINKRSSNHDCKRKHPRPSTREL

SEQ ID NO: 294 - protein, 323 aa, Buchnera aphidicola
MIVKFEKFEKLKKPLVIFLMGPTACNKSLLAMTLKDILPIELVSVDSALIYRGMDIGTAKPSNMELLKYPHFLVNIRDPLQTYSVGEFYKDILKIIDYIHSINKVPLLVGGTMFYFKILLTGGLSNLPSSNDNIRKYLLTLLQKKSKFFLFNQLKSIDPISAERIHFNDVQRVLRALEVFFISGKTLTELCRLKNFVSPYNIVQFSLMPESKEWLFNKITIRFKKMLSCGFEYEVKKLFNRGDLHKNLPSIRCVGYRQMWDYFMHNLTYDDMICESLKATKRLVKSQLTWLNNWKKLNVLSSSDTLKNLITKIISVINANIFV

SEQ ID NO: 295 - protein, 317 aa, Xylella fastidiosa
MPADTRPAAIVLMGPTASGKSQLAIDIAKRWGGEVISVDSVLVYRGLDIGTAKPNAAMRASVPHHLIDICEPWETYSAADFAHDARAAIDMIVRRGALPILTGGTGLYFRALLAGLSDMPPAHPEIRAMIAAEAKRDSWAALHTRLAEVDAITAARIHATDPQRIQRALEVYLVSGQSMSDWQNQPPKQRLPLRVLKLVLAPTHRKVLHFRIAQRFKAMLDNGLLAEVNALRTHPSIHAMARPLDLPAMRAVGYRQCWEHLDGMYTAEMLYQRSVAATRQLAKRQLTWLRGELDALWFDPEHDQSRIEKVMEAFLNR

SEQ ID NO: 296 - protein, 314 aa, Clostridium tetani
MKDLFILSGPTAVGKTEISLNLAKALRGEVISSDSMQIYKHMDIGSAKIFEEERQGIPHHLIDVVEPWENFSVAEYKNIAENKIEEIYNRDNIPMLVGGTGLYINSIIYNYSFTDANKDNDYRDYLEKLAKEKGKEYIHSLLKDIDEYSYNNLHYNNLKRVIRALEVYKVTGKPMSQYAKEEKENLFNIPYSIYYFVLYMDRDKLYDKINMRVDRMLQEGLLDEVKELKEMGCNETMQSMQGIGYKELLYYLNGEISFNEAVYLIKKGSRNYAKRQLTWFRRDPRAIWINKDEFENDDAIVKEILNKFNKLKGF

SEQ ID NO: 297 - protein, 311 aa, Lactobacillus plantarum
MTTVTKHKVLLIAGPTAVGKTALSLALAKQLNGEIISGDSMQVYRHLDIGTAKIMPEEQAGIPHHLIDIKNIDQRFTVAEFVSRTTALIIDISARGKLPIIVGGTGFYLQSLLAGYQFGPADNEPDMAYRQAWFDRAAVEGSDVAWMALKQRDPQAATAIAPANLVRVVRALEYVHTTGQLFSEQADTHGDTLDAYTLCLTAERALLYTRINQRVDQMVAAGLEQEARWLFDQGGAMLPAGKGIGYHEWFPYFNGEQTRDESIAKIKQDSRRYAKRQLTWFRNKMSVDWINLLEHPELRASIDQRLASWLS

SEQ ID NO: 298 - protein, 301 aa, Tropheryma whipplei
MLAVAFVGATGTGKSLLSLDAARDFNGHIVNADSMQLYRDMDIGTAKLSHSARQGIPHHQIDVIDPSSEASVARYKLSAQTCIKHIHALNSIPFLVGGSGLYVSSVVHNLQFPPTDGRVRKLLEDEADKSGIGVLHDRLLKLHPGFTVSRGNRRRIIRALEVAYITGRSPNPVLPLQNRANNFIVINLICDKGTLDIRLQKRVESFYDNGLIDEVRLLQEKYVLGRTAAKAIGYKQAIMYLAGEISCADAKDSTLQETIRLANKQIKWFRRYSGQHIVDTTDMSVAYEQIRSILNKSFRIS

SEQ ID NO: 299 - protein, 286 aa, Tropheryma whipplei
MLSLDAARDFNGHIVNADSMQLYRDMDIGTAKLSHSARQGIPHHQIDVIDPSSEASVARYKLSAQTCIKHIHALNSIPFLVGGSGLYVSSVVHNLQFPPTDGRVRKLLEDEADKSGIGVLHDRLLKLHPGFTVSRGNRRRIIRALEVAYITGRSPNPVLPLQNRANNFIVINLICDKGTLDIRLQKRVESFYDNGLIDEVRLLQEKYVLGRTAAKAIGYKQAIMYLAGEISCADAKDSTLQETIRLANKQIKWFRRYSGQHIVDTTDMSVAYEQIRSILNKSFRIS

SEQ ID NO: 300 - protein, 323 aa, Pseudomonas syringae
MNALPPAIFLMGPTAAGKTDLAIELSKVLPCELISVDSALVYRGMDIGTAKPSKAQLAEFPHRLIDILDPAQSYSAADFRSDALAAMAQITARGNIPLLVGGTMLYFKALLDGLADMPAANAAVRAQLEADAQAFGWQSLHDQLAVVDPVSAARIHPNDPQRLIRALEVYRVSGMSMTAHREQQTAQSTEAAASGCQQLPYTVANLAIAPADRKVLHQRIALRFEQMLDQGFLDEVLALRSRGDLHAGLPSIRAVGYRQVWDHLDGKLTREEMQERGIIATRQLAKRQFTWLRSWDDLHWLDSLASDNLSRALKYLGSVSILS

SEQ ID NO: 301 - protein, 310 aa, Vibrio parahaemolyticus
MTDKLPLALFLMGPTASGKTELAIRLRQKFPVEIISVDSALIYKGMDIGTAKPDERELSLAPHRLIDILDPSESYSAADFRRDALQAMDDIVAEGKIPLLVGGTMLYYKALLEGLSPLPAANPEIRQQIEQEALTKGWSVLHDELKEIDPVSAARIHPNDPQRLSRALEVYRISGKTLTELTQTKGESLPYRVKQFAIAPKDRAELHRRIELRFDKMMEAGFEEEMKALYARKDLHPDLPSIRCVGYRQMWEYLDGECTRDEAVFRGVCATRQLAKRQITWLRSWDDLTWLDSDNIEQALETMSEAIASD

SEQ ID NO: 302 - protein, 471 aa, Neurospora crassa
MADPLVVIYGSTGTGKSDLAVELATRFNGEIINVDAMQMYRGLPIITNQLTPEEQRGIPHYLLGNIGLDEEPWSVTSWKREATRIISDIRSRGKLPIVVGGTSYYLDGLLFDEKLVESDPATTEESETAAAKATRDELASQHPILRESAEVMLAKLQEVDPVMAERWHPKDIRKIRNSLEIYLSTGRRASDIYAEQRARKEAKRAEQPPSPWNLLLFWLYAKPDVLNERLDKRVDKMVANGLLDETSSVYDYLQRRLAAGDTVDRTKGIWQSIGFRQFESYLSAVKSTETDTPQAALEKLKQQGIEDTKTATRQYAKYQIRWIARKTIAALQEENLLSNFYLLDSSNISHWHSEVAEKGSSLLAKHLAHQPLPRPEDLSDTAREVLAEQLERSNRPETICNKTCEVCGKEFRIEEQWQKHLKSKKHQKAVKWARRQAEGWPTRGVAKGDKVEEGTDDDVDADDSDGQVPKP

SEQ ID NO: 303 - protein, 316 aa, Salmonella enterica
MNDVSKVSLPKAIFLMGPTASGKTALAIELRKVLPVELISVDSALIYRGMDIGTAKPNADELKAAPHRLLDIRDPSQAYSAADFRRDALAQMAEITAAGRIPLLVGGTMLYFKALLEGLSPLPSADPEVRSRIEQQAAELGWEALHQQLQEIDPVAAARIHPNDPQRLSRALEVFFISGKTLTELTQTSGDALPYQVHQFAIAPASRELLHQRIELRFHQMLASGFEAEVRALFAREDLHTDLPSIRCVGYRQMWSYIEGEISYDEMVYRGVCSTRQLAKRQMTWLRGWEGVRWLDSENPDRARKEVLQVVGAIAD

SEQ ID NO: 304 - protein, 308 aa, Bacteroides thetaiotaomicron
MPTLIVLIGPTGVGKTELSLRLAENFHTSIVSADSRQLYAELKIGTAAPTPDQLKRVPHYLVGTLHLTDYYSAAQYEQEAMEILHQLFTEHEVVVLTGGSMMYVDAICKGIDDIPTVDAETRQVMLQKYEEEGLEQLCAELRLLDPDYYRIVDLKNPKRVIHALEICYMTGKTYTSFRTQQKKERPFRILKIGLTRDREELYDRINRRVDQMMEEGLLDEVRSVLSYRHLNSLNTVGYKELFKYLDGEWELPFAIEKIKQNSRIYSRKQMTWFKRDEEIRWFHPEQETEILEYLRLQNLTHLPSLDTF

SEQ ID NO: 305 - protein, 306 aa, Bacteroides thetaiotaomicron
MPDYDLITILGPTASGKTPFAAALAHELNTEIISADSRQIYRGMDLGTGKDLADYTVDGHPIPYHLIDIADPGYKYNVFEYQRDFLISYESIKQKGCLPVLCGGTGMYLESVLKGYKLMPVPENPELRARLANHSLEELTEILKQYKTLHNSTDVDTVKRAIRAIEIEEYYAVHPVPEREFPKLNSLIIGVDIDRELRREKITRRLKQRLDEGMVDEVRRLTEQGISPDDLIYYGLEYKFLTLYVIGKLTYEEMFTELETAIHQFAKRQMTWFRGMERRGFTIHWVSAELPMEEKIAFVIEKLRGN

SEQ ID NO: 306 - protein, 309 aa, Enterococcus faecalis
MEKVLVIVGPTAVGKTALSIALAKKFNGEIISGDSMQVYRSLDIGTAKVTETEKEGIPHYLIDCREVSETYSAADFQKEGRQKIKEITEKGKLPIIVGGTGLYIQSLLYDFQLGSREIDDSPEIRETYNLFAEEKGNQALWLLLQQKDPLAANSIHFNNRKKVIRALEVFDKTGYSILTPKEKPARLYDYYLLGLETDRALLYERINQRVDQMMTEGLLEEAKQMFQQPHAQAAQGIGYKEFFPYFSGEQSLEMAVETVKQQSRRYAKRQLTWFRNRMAAHWWNLVQQPTDLPKLEKEVAEWLQQKESE

SEQ ID NO: 307 - protein, 311 aa, Coxiella burnetii
MNKNPFIVCLMGPTASGKTDLAIALARKLPFEIISVDSAMVYRGLDIGTAKPNEEELQLTSHRLINICDPSFPYSAGQFYKDALSEIKTIEIRNRTPLLVGGTMLYFHILEQGFSDLPTADETVRKKIQEEAAQHGWAKIHERLNAIDPKSAARINPNDAQRIQRAFEVYETTGQPLSSYQSLKRFKALPYQFINLILAPENRSWLHQRIEKRFDQMLKNNFLEEVRQLYNRGDLNSDLPAIRTVGYRQVWKYLSGEYDYETMRHKAIAATRQLAKRQLTWLRRWPDAKWFNSEDKDLISQVVDYLKGIGM

SEQ ID NO: 308 - protein, 312 aa, Streptomyces avermitilis
MSSAPPAPRVIAVVGPTAAGKSDLGVFLAQRLDGEVVNADSMQLYRGMDIGTAKLTPEERGGIPHHLLDIWDVTVAASVAEYQRLARARIDALLAEGRWPILVGGSGLYVRGAVDNLEFPGTDPEVRARLEEELALRGPGALHARLAAADPEAGHAILSSNGRRIVRALEVIEITGRPFTANLPGHDSVYDTVQIGVDVARPELDERIARRVDRMWEAGLVDEVRALEAQGLREGRTASRALGYQQVLAALAGECTEDEARAETVRATKRFARRQDSWFRRDPRVHWLSGAAADLTELPQLALMLVERPVTA

SEQ ID NO: 309 - protein, 342 aa, Chlamydophila caviae
MRAPEFQSNTTTSTGCDVCLDPQKSFANLFKRTVILLSGPTGSGKTDVSLRLASMVDGEIISVDSMQVYRGMDIGTAKVSLEDRQRIPHYLIDICHVQELFNAVDFYYQAMHACQNILSRNKVPILVGGSGFYFHTFLSGPPGGPPADREFRDQLALYIQDHGLSFLYENLCQKDPEYARTITKNDKNKIVRALEIIHLTGRKVSEHSWSMEPQESREYNCRGWFLSPPKELLLDNIQLRCQKMLEDNLIGEVRGLLEQGIRENSSASKAIGYREWIEFIDQGSPEEAYEAVKQKFITNTCQYTKKQRTWFKRYPVFRELPTLGLTAETLAGKIAEDYFLHG

SEQ ID NO: 310 - protein, 317 aa, Bacillus cereus
MGEVQREKVAVIIGPTAVGKTKLSIDLAKALNGEIISGDSMQIYRTMDIGTAKVTKAEMDGIPHYMIDIKNPEDSFSVAEFQERVRKHIREITERGKLPIIVGGTGLYIQSVLFDYQFTDDAGDVIYREQREKLALERGVEYVHEKLQEVDPESAERIHANNVRRVIRALEIFHTTGEKMSEQIEKQEKELLYDVSLIGLTMDREMLYDRINLRVDLMMEQGLLEEVEGLYNRGIRDCQSIQAIGYKEIYDYFENRASLEDAVSQLKTNSRRYAKRQLTWFRNKMDVTWFDVTDGEKTSEILRYIEGKLQVKSNNSK

SEQ ID NO: 311 - protein, 317 aa, Nitrosomonas europaea
MNYPDIESPPAIFLMGPTASGKSAMALEIARRFPVEIIGVDSAQVYRFMDIGSAKPDKLILSEIPHHLIDLIDPDENYSAARFREDALSVMREITARGRVPLLVGGTMLYFKVLRQGLAALPPADDSVRRALEQQALDKGWPAMHAVLSQLDPVTAGRIQPNDSQRIQRALEVCYLTGKPMSEMLEQQQNADFPFRVFNIALLPGDRSVLHDRISQRFATMLEAGLIDEVRLIREQFHVNGDMPSMRCVGYRQVCMYLDNEISFARMQETGVFATRQLAKRQLTWLRSMSGLQIFDCLENRLARQIIDLIQAQRLFS

SEQ ID NO: 312 - protein, 314 aa, Bacillus anthracis
MQREKVAVIIGPTAVGKTKLSIDLAKALNGEIISGDSMQIYRTMDIGTAKVTKEEMDGIPHYMVDIKNPEESFSVAEFQERVRKHIREITERGKLPIIVGGTGLYIQSVLFDYQFTDDAGDAIYREQMEKLALERGVEYVHKKLQEVDPESAERIHANNVRRVIRALEIFHTSGEKMSDQLEKQENELLYDVSLIGLTMDREMLYDRINLRVDIMMDQGLLEEVEGLYNRGIRDCQSIQAIGYKEIYDYFEDRVSLEEAVSQLKTNSRRYAKRQLTWFRNKMDVTWFDVTDGEKTSEILRYIEGKLQLKSNNSK

SEQ ID NO: 313 - protein, 315 aa, Vibrio vulnificus
MTEQLPLALFLMGPTASGKTELAIRLRQRYPVELISVDSALIYKGMDIGTAKPDEREQQLAPHRLIDILDPTEAYSAADFRRDALAAMNEIVAQGKIPLLVGGTMLYFKALLEGLSPLPAANAEIRQQIEQEALTKGWSVLHDELQEIDPVSAARIHPNDPQRLSRALEVYRISGKTLTELTETKGESLPFRVKQFAIAPKERAELHRRIELRFDKMMEAGFEQEMRALYTRKDLHPDLPSIRCVGYRQMWDYLDGNCTLDEAIYRGICATRQLAKRQITWLRSWDNLTWLDSENIEQSLETLSEAIASDRDSCV

SEQ ID NO: 314 - protein, 64 aa, Haemophilus somnus
MWEYLQGNYGKDEMIFRGICATRQLAKRQLTWLRGWKSPIEWLDSLNPKSAKEKIIKTIKHNCK

SEQ ID NO: 315 - protein, 66 aa, Actinobacillus pleuropneumoniae
MWEYLDGDISLDEAIYKGICATRQLAKRQITWLRGWNSEITWLDSLDPTSSKLKMIEKIAQNSIKL

SEQ ID NO: 316 - protein, 313 aa, Pseudomonas aeruginosa
MGPTAAGKTDLAMALADALPCELISVDSALIYRGMDIGTAKPSRELLARYPHRLIDIRDPAESYSAAEFRADALAAMAEATARGRIPLLVGGTMLYYKALLEGLADMPGADPEVRAAIEAEALAEGWEALHRQLAEVDPESAARIHPNDPQRLMRALEVYRLGGVSMSDLRRRQSAEKADFDASGRNQLPYTVAQLAIAPEQRQVLHARIAQRFRQMLEQGFIAEVEALHARSDLHAGLPSIRAVGYRQVWDYLDGKLSYAEMTERGIIATRQLAKRQFTWLRSWSHLHWMDSLAGDNLPRALKYLKTVSILA

SEQ ID NO: 317 - protein, 334 aa, Pirellula sp.
MHPDTRSQPFAPLFDDVIVLTGPTASGKTELALRVAETLAARTNGRQEIEILSLDAIAVYRGMDIGSAKPTSDQLARAPHHLIDLVDPWDEFSVAEYLHSAHACVQDILERSKRPMFVGGTPMYLKGVLRGFDAGPPADEAFRNAVEEDLRQHGIGALRERLHQVDPLSAAKIDRGDSRRMIRALEFARATGTPISHRQLQFDTARSSHEGLVFALRVPRPVLHQRIEKRVEEMFAEGLVAEVQGLLALEQPLSKTSRQAVGYREIIEAIAAGDAPETAAERVVFHTRRLARRQETWLRSFSEIRGLGSFESDSAPDIDQCVESMVETILSFSD

SEQ ID NO: 318 - protein, 322 aa, Wigglesworthia glossinidia
MNENKCTDKINNLPKAIFIMGQTAVGKTKIAEILKKKLPVEIISVDSGCIYKGMNIGTDKPNVKKSSSDKYHLIDICEPNDYYSVENFRLDALKIMEKISKKGLIPLLVGGSMFYFKSLLHGLSNLPSYNIENKNLLKKKINEIGWYKSYIFLKKIDPIFASNIHPNDHYRLTRALEIYFSSGNIPTNLFKAKTKKLEYNIRQFSIMISDKKILYKKIKDRFFNMLKNGFKKEVEFLKNKKQINKNMPSMRCIGYKQMLAYLSGEINYKEMILFTISATNKLAKKQSTWLKKWKNINYIYNKDVYISSEEIFNILKKDNFID

SEQ ID NO: 319 - protein, 299 aa, Prochlorococcus marinus
MQNPKPLVIVLLGPTASGKTDLAIQIAKKIKVSIHNIDSRQLYKGMNIGTAKPTIEQQEEIKHYLLDLKDPNNPITLHEFKKEAELSLKNIFSKEKCGFLVGGSGLYLKSLTSGLCPPSVPAQEKLRKEFRRLGQKECHQILKKCDPIAWEKISPRDSIRTIRALEVFYSTGQTISSLKTLKPPDWNLLELGLDPRNLQQRIAKRTKILFQKGLIDETKALIHQYGEDLPLLQTIGYKEACTVIKGEYSITEAIEITTQRTNQFAKKQRTWFRRQHNPKWLNEKNSLEEALSLIQNVIG

SEQ ID NO: 320 - protein, 98 aa, Agrobacterium tumefaciens
MLLHLIYGPTCSGKTDMAIQIAQETGWPVVALDRVQCCPQIATGSGRPLESELQSTRRIYLDSRPLTEGILDAESAHRRLIFEVDWRKSEEGLILEGG

SEQ ID NO: 321 - protein, 65 aa, Escherichia coli
MSDISKASLPKAIFLMGPTASGKTALAIELRKILPVELISVDSALIYKGMDIGTAKPNAEELLAA

SEQ ID NO: 322 - protein, 216 aa, Escherichia coli
DPLLVGGTMLYFKALLEGLSPLPSADPEVRARIEQQAAEQGWESLHRQLQEVDPVAAARIHPNDPQRLSRALEVFFISGKTLTELTQTSGDALPYQVHQFAIAPASRELLHQRIEQRFHQMLASGFEAEVRALFARGDLHTDLPSIRCVGYRQMWSYLEGEISYDEMVYRGVCATRQLAKRQITWLRGWEGVHWLDSEKPEQARDEVLQVVGAIAG

SEQ ID NO: 323 - protein, 240 aa, Agrobacterium tumefaciens
MDLRLIFGPTCTGKTSTAVALAQQTGLPVLSLDRVQCCPQLSTGSGRPTVEELKGTSRLYLDDRPLVKGIIAAKQAHERLMGEVYNYEAHGGLILEGGSISLLKCMAQSSYWSADFRWHIIRHELAHEETFMNVAKARVKQMLRPASGLSIIQELVDLWKEPRLRRILKEIDGYRYAMLFVSQNQITSDMLLQLDADMEDKLIHGIAQEYLIHARRQEQKFPRVNAAAYDGFEGHPFGMY

SEQ ID NO: 324 - protein, 136 aa, Nostoc sp.
MRLHIILGPTSVGKTDRSVVLAKQTKAPVIVLDRIQIYQEIATGSGRPLIDELEGTTRIYLEERQLADGNLNTLESLSLALQHIDRLSSQHKLLILEGGSISLCTALWKSRILENYQTTIEYVKVENEELYQSRMW

SEQ ID NO: 325 - protein, 240 aa, Agrobacterium tumefaciens
MDLRLIFGPTCTGKTSTAVALAQQTGLPVLSLDRVQCCPQLSTGSGRPTVEELKGTSRLYLDDRPLVKGIIAAKQAHERLMGEVYNYEAHGGLILEGGSISLLKCMAQSSYWSADFRWDIIRHELADEETFMNVAKARVKQMLRPAAGLSIIQELVDLWKEPRLRPILKEIDGYRYAMLFASQNQITSDMLLQLDADMEDKLIHGIAQEYLIHARRQEQKFPRVNAAAYDGFEGHPFGMY

SEQ ID NO: 326 - protein, 259 aa, Agrobacterium vitis
MIHFSNQKNINLYSRYRKTLMDLCLIFGPTCTGKTSTAIALAQQTGQPVLSLDRIQCCPQLSTGSGRPTVEELNPTTRLYLDEQPLVKGIISAKQAHERLIAEVYNNEAHGGLILEGGSISLLKCMVQSSYWSNDFRWRIIRHKLADEETFIKAAKARVKQMLRPAAGLSIIQELVHLWNQPQLRPILEGIDGYRYAMLFASQNQITPDMLLQLGADMEDKLVEGIAQEYLRYARLQEQEFPSINAVAFEGFEGHPFGM

SEQ ID NO: 327 - protein, 239 aa, Agrobacterium tumefaciens
MDLRLIFGPTCTGKTSTAIALAQQTGQPVLSLDRVQCCPQLSTGSGRPTVEELKGTTRLYLDEQPLVKGIISAKQAHERLIAEVYNNEAHGGLILEGGSISLLKCMVQSSYWSNDFRWRIIRHKLADEETFMKAAKARVKQMLHPAAGLSIIEELVHLWNQPQLRPILEGIDGYRYAMLFASQNQITPDMLLQLGADMEDKLAHGIAQEYLIHARRQEQEFPSINAVAFEGFEGHPFGM

SEQ ID NO: 328 - protein, 322 aa, Pseudomonas putida
MSGKPPAIFLMGPTAAGKTDLAIELTKVLPCELISVDSALVYRGMDIGSAKPSKEILAAHPHRLIDIRDPAESYSAAQFRADALEAMAEITARGKIPLLVGGTMLYYKALIDGLADMPADAAVRAELERQAEALGLAELHRQLAEVDPESAARIHPNDPQRLIRALEVYRVSGESMTAHRQRQFAESRGADAGAGGHLPYTVASLAIAPTDRHILHQRIALRFSQMLEQGFVDEVRSLRARSDLHAGLPSIRAVGYRQVWDYLDGKLTENEMRERGIIATRQLAKRQFTWLRGWPEVHWLDSLACDNLSRTLKYLGAISILS

SEQ ID NO: 329 - protein, 428 aa, Saccharomyces cerevisiae
MLKGPLKGCLNMSKKVIVIAGTTGVGKSQLSIQLAQKFNGEVINSDSMQVYKDIPIITNKHPLQEREGIPHHVMNHVDWSEEYYSHRFETECMNAIEDIHRRGKIPIVVGGTHYYLQTLFNKRVDTKSSERKLTRKQLDILESTDPDVIYNTLVKCDPDIATKYHPNDYRRVQRMLEIYYKTGKKPSETFNEQKITLKFDTLFLWLYSKPEPLFQRLDDRVDDMLERGALQEIKQLYEYYSQNKFTPEQCENGVWQVIGFKEFLPWLTGKTDDNTVKLEDCIERMKTRTRQYAKRQVKWIKKMLIPDIKGDIYLLDATDLSQWDTNASQRAIAISNDFISNRPIKQERAPKALEELLSKGETTMKKLDDWTHYTCNVCRNADGKNVVAIGEKYWKIHLGSRRHKSNLKRNTRQADFEKWKINKKETVE

SEQ ID NO: 330 - protein, 311 aa, Helicobacter pylori
MIKEGFLIKTPKKLIALLGPSGSGKSALSIELAQELDAEIFSLDSLSIYKDINIASAKPSLKERKNIKHYALDHLNIDEKNNAPLFKTLLEDAMRVSSKEILLIVGGSSFYLKSILEGLSRMPKLSGEEVVKIEREIATLSNPYIFLKSIDPNMAFKIHPNDTYRTHKALEIFYATCTPPSEYFKANPKKPFEHAISLFALSIEKSALHNNIKRRTKNMLHSGLVEEIKALYTQYPKDSQPFKAIGVKESVLFLEKRLTLKELEEAITSNTMKLAKRQNTFNKTQFNNLYVGSAEEVRHAILKHSKSGIKG

SEQ ID NO: 331 - protein, 312 aa, Helicobacter pylori
MIKEGFLIKTPKKLIALLGPSGSGKSALSIELAQELDAEIFSLDSLSIYEDINIASAKPSLKERKNIKHYALDYLNIDEKNNASLFKTLLEDAMRVSSKEILLIVGGSSFYLKSILEGLSGMPKLSDEEVVKIEREIATLSNPYIFLKSIDPNMAFKIHPNDTYRIHKALEIFYATHTPPSEYFKANPKKPFEHAISLFALSVEKNALANNIKQRTKSMLDCGLIEEIKALYIKYPKDSQPFKAIGVKESVLYLEKRLTLKELEEAIISNTMKLAKRQNTFNKTQFNNLYMGSVGEIRHAILKHSKSDTRER

SEQ ID NO: 332 - protein, 297 aa, Methylobacterium extorquens
MRSPDGQETGRPAAILIAGPTASGKSALGLRIARAFGGTVINTDSMQVYADLRVLSARPTAEEEELAPHRLYGSIDGAVNFSVGHFQRQAAALLSEMDAGTPPVFVGGTGLYFRSLDEGISDLPEVPDAIRQQIRAEADGQQTETLHAAMRALQIHAATGRSIGSFHEARVPGPLAGKPLLKLFLATEREALRQRIDARFVTMMEQGALDEVAALRERRLDPLLPVMRAHGVPGLIAYLDGTISREEAIQRGQGDTRWARIGTGPRRKQRGPWSRPRRYAKRQFTWFRHRLSAPAGR

SEQ ID NO: 333 - protein, 306 aa, Mycoplasma gallisepticum R
MIYSKRLILVVGPTGTKKSYLANMLAKKLNVPIISADAYQVYKELNAGVNKPSEKTLSEIKYHFISNISIFDEWSIAHFNKRAKEILEQAPDWTIVCGGSHLYVNSLINDYQLEKQELDTDLFDALDKLDNQEIFNQLCEYDFQEAIKIGKNNRKRLLRALYLFKKYGKKAKNDSKKFDYVVVKCMSDKEKLFPYLSKRLDEMIHDLNWTKEIEYLDKIITDKKLDKELIAMKALGYKEIYDAWKNNQPIDKEIINKKFKRLVKHQLTWTRNKFNDGMKQFTFNFFEDDANRTCDEIIEYIKSNHD

SEQ ID NO: 334 - protein, 302 aa, unidentified
MKIIAVLGSSGSGKSALAHRIAMEQNCKIFSLDSLSIYKYLDIASAKPTLLEQSQVCYYALNILEPHQKSNVMIFKDLLLQSIEDIKNNSPHTPLLIVGGSSFFLKSIMEGLSPMPPLEEHEEWVKSLGNISMQYAQLTQIDKTYAQSLSPTDTYRICKALALFKATNTPPSIYFATHKKESLGYDIEIFCLECERDELRERIAKRTKAMIQKGIVEEVQNVLEAYGAQAPALNAIGAKECVNFLQGKVATLQQLEEQIFFHTCQLAKRQRTFNRTQFAQITHLKEKALEAQLIQQIHNNIL

SEQ ID NO: 335 - protein, 313 aa, Haemophilus ducreyi 35000HP
MNKPVAIFLMGPTASGKTDLAIALRKQLPVEVISVDSALIYKEMDIGTAKPTAAELAQAPHRLIDILDPKESYSAMHFHADALHAMADITASGRIPLLVGGTMLYYKALLEGLSPLPSANEHIRTEIEAHANQYGWASLHQQLTQIDPLAASRINANDSQRINRALEVFYLTGKNLTELTAQQGECLPYQVLQFAIAPQERAVLHQRIEQRFHKMMELGFLTEVEKLYARGDLHPDLPAIRCVGYRQMWQHLAGEISLDEAIYKGICATRQLAKRQLTWLRGWRSEITWLDSLDPTSSQEKMIQNLEQNFIKL

SEQ ID NO: 336 - protein, 323 aa, Candidatus Blochmannia floridanus
MRKYFKERDVPFIIFLMGPTASGKTSVVIELKKQKLGIKIISVDSALVYKNMNIGTAKPSVDELEIAPHQLIDIRDPADCYSVSDFYHDAILEINKIIRSGYVPVLVGGTMLYFKTLLTGLYQLPGKSQNIRNDLIYEAQKIGWVNMYNKLKCIDPIVSKTIHCNDHKRIIRALEVFLSSGKTLTELKQKFLNQQSQRYKVLQFALMPSKREFLYNRIEQRFYKMLKSGFEDEVRLLFSRPDLHDGYQSSISCVGYRQMWEYLSGNVEYDQMIYKGIYATRRLVKNQLTWLKKWPNVHWLNGDNVLIAVNDMLSVLSKYSCVI

SEQ ID NO: 337 - protein, 313 aa, Bordetella pertussis
MTPRAIICLAGPTAAGKSASTLALAQRWPLEIINVDSATIYRGMDIGTAKPSAAERAQVPQHLLDIRDPAQSYSAAEFRADALRLIAEIHARGRIPLLAGGTMLYYKALREGLDDLPQADPALRAELEARAARLGWPALHAELALLDPATAARLSPNDSQRIQRALEICRLAGQPMSALLQGERRGDAPSPYRYVTLSLEPSERAALHARIAQRFDAMLAAGLVEEVRGLHARPDLHPGLPSVRCVGYRQMWSYLDGDIDLDTAREQGVAATRQLAKRQLTWLRAQPERVIIDCLAGDAVARTVDAMARALPD

SEQ ID NO: 338 - protein, 313 aa, Bordetella parapertussis
MTPRAIICLAGPTAAGKSASTLALAQRWPLEIINVDSATIYRGMDIGTAKPSAAERAQVPQHLLDIRDPAQSYSAAKFRADALRLIAEIHARGRIPLLAGGTMLYYKALREGLDDLPQADPALRAELEARAARLGWPALHAELALLDPATAARLSPNDSQRIQRALEICRLAGQPMSALLQGERRGDAPSPYRYVTLSLEPSERAALHARIAQRFDAMLAAGLVEEVRGLHARPDLHPGLPSVRCVGYRQMWSYLDGDIDLDTAREQGVAATRQLAKRQLTWLRAQPERVIIDCLAGDAVARTVDAMARALPD

SEQ ID NO: 339 - protein, 299 aa, Prochlorococcus marinus subsp. pastoris str. CCMP1986
MFQPKPLVIVLIGPTASGKTELGIEIAKYFNLNIHNVDSRQLYRFMDIGTAKPTKEQQKTIKHFLIDLEEPSSQVNAKQFQEIATKSINRELNQNRIPFLIGGSGLYMNSIIKGFFAPNVPPQKVLRSQFEKLGQEKCWELLKICDPVLTKKINYADQVRTIRALEVFYVTGKPISSQKFQNPPPWKILELGLYREDLKERIFKRTKNMFEFGIIDETKKIINQYGSNLPLLETIGYREAKDVIKENLKLEKAIEITTTKTIQFAKRQKTWFRNKNNPIWLNNKNLLKDAIINIKHALR

SEQ ID NO: 340 - protein, 299 aa, Prochlorococcus marinus str. MIT 9313
MPASKPLLIALLGPTASGKTCLALQLAEQLKLSVLNVDSRQLYIGMDVGTAKPTKEQQRRVQHHLIDLRRPDQPITLQEFQAAAQLILAQKLREQNMPFLVGGSGLYLKALTCGLRPPAVPPQPELRKQLGELGQRTCHHLLQAADPTAANRISPADAMRTQRGLEVVYATGKPITTQQGSSPPPWRVLELGLDPHNLRERIGHRTTQLYANGLIEETEHLSHCYDTDLPLLQTIGYGEALKVIQGLLNREQAIALTTRRTQQFAKRQRTWFRRQHHPYWLKGEEPLSEALSLIQAGLR

SEQ ID NO: 341 - protein, 299 aa, Synechococcus sp. WH 8102
MTQPEPLVITLLGPTASGKTALSLEIAERLNLPVINVDSRQLYREMTVGTAKPTAEQRARVPHHLLDLRNPDQPITLQEFQAEAEPCIQRELQSRGMALLVGGSGLYLKALTSGLKPPAVPPQAQLREQLSQLGQAICHPLLQQADPTAGAKIAPADAVRTQRALEVLYATGRPMSSQATATPPPWRVLELGLDPANLRQRIQQRTDQLYSDGLVEETRQLSERYGADLPLLQTIGYGEALQLLEGTMNQAKANRITTQRTRQFAKRQRTWFRRQHQPHWLAPATELDQAMTLIEQHLR

SEQ ID NO: 342 - protein, 306 aa, Synechococcus sp. PCC 7942
MESRLKPGLIVLCGPTAAGKSSLAIAIAQRLGSPILSADSRLVYRDFNIGTAKPTPAEQQQVPHYLMDLCDPRQVFTVGDYQDCAVPLIQQLQEKGMLPLLVGGTGLYIKAIVNGLRFPRIAPQPKLRSQLQALGQPLCHALLQRVDPVAGDRIHVNDRVRTLRALEVFYVSGDRLTDLQQEQPPSYPILQIGLDSDRLEARIQQRTQQMLTSGFVEEVQGLCDRYGSDLPLLNTLGYRQVCAFLQGSLSRSELPEQIVLQTRQYAKQQRTWFRADSSIQWIDAEASNRLERALDLIERFRKSEGV

SEQ ID NO: 343 - protein, 325 aa, Chromobacterium violaceum ATCC 12472
MSDTPQAILLMGPTASGKTGLALELARRFPVEIVSVDSALVYRDMDIGTAKPTAEEMAACPHHLIDVISPLQSYSAAQFHADANRLIADIQARGKLPLLVGGTMLYYKALLEGLSDLPQADAALRAELDADAALLGWPAMHARLAELDPATASRLNPNDSQRIHRALEVCLLSGKPMSELIAQGKEAAAGFRFLPLALVPRERGWLHARIAERFRIMLEQGFLDEVSRLRAKYPELTLNLPSMRCVGYRQAWEHQDGLYGHDEFVERGVAATRQLAKRQLTWTRSLDAIPVDAQRDGLAGLLGDAVDDFLAGRPPAESLRYAGDF

SEQ ID NO: 344 - protein, 300 aa, Porphyromonas gingivalis W83
METQDHTLYVLLGPTGVGKTDLSLDIAERLGSPIISADSRQIFRELPIGTAAPTPEQRAKVPHLFVGTHSVRDYYSAGMYEVEVLEALKELFRKYRGVLLTGGSMMYIDAVCRGIDDIPDPFPEVREELYARYAAEGLDGILAQLRLLDPDYYAKVDRRNYKRVIHGLEICLSTGRPFSSFHRHEAKERPFRIVKIGLYREREELCKRIDARVLEMMEQGLEEEARAVYPLRHLNALNTVGYKEMFEYFDGSIDRAEAVRRIQRNSRVYARKQMTWFRRDSTIRWFHPEADKGTVLTLVT

SEQ ID NO: 345 - protein, 302 aa, Porphyromonas gingivalis W83
MITILGPTACGKTRLAVSLAYRLETEIISADSRQIYRGMDIGTGKDLADYQVGGTTIPCHLIDIRPAGDKYNLFAYQHDFHQAYASILARGMDPILCGGTGMYIEAVLKGYHLPDVPPNPTLRDRLQGKSLTELTLILAAYGPLHNKTDVDSAQRAIRAIEIAEYIKNNPVESTEFPPIDSLIIGLDLDRDTRRKRITDRLHARMHEGMIEEVKGLLDSGIPAEDLIYYGLEYKFVTLYLTGQTDYESMFTGLETAIHQFAKRQMTWFRGMERRGFLIHWIDALLPADEQCEAVMKLYGANG

SEQ ID NO: 346 - protein, 300 aa, Wolinella succinogenes
MKIFAILGASASGKSALGLRLAKELECFILSLDSLSIYQEINIASAKPSKEELLSIRHFGIDLLTPNEPSNAALFAHLFEEALEASNQAGKKALLLVGGTGFFLKRIIEGLSPAPTLDPSAKEWLKEVLENRREAFKELEKIDPLYTSRITPSDLHRLRRGWEIYLGSGLSPSLFFETHPPKPLGHDLKIYELTLERELLRQRITERTEQMLESGLIDEVCQLESRYTREPQAMKSIGIAETLAYLDGEISKEELTPLISTHTAQLAKRQTTFNKTQFTSIRHLEAPRLFEEICHTITKS

SEQ ID NO: 347 - protein, 363 aa, Rickettsia sibirica
MLACNDDTSLYLLVKQVTKKEIYSNDLEHGNVKRGASTHSLYLIGDPKCCRNNSSKQKSIIILCGPTASGKSYLGHELAKAYNGEIINIDSMQVYKEIPIITASPPKSYKTEILYHLYNFLSMTEDFSVIKYLKLATEKIKEITDRGKLPILIGGTGLYINSLVFGYNNIPDISADLQEQVRNLHVKIGNIELWSKLEKFDPLAASKINQNDTQRLIRAYEVFMQTGKSIFSFQTLPKEQILSDFNFKIIFLNPERKFLYKTCDERLDKIFKEGAIDEIALIKKQFAPKDYTNLKAVGIKEILAYLNGNLTLDEALNAAQIRTRQYAKRQVTWFKNQIQDKITLEYANQEEFTQTLKNPFKII

SEQ ID NO: 348 - protein, 306 aa, Fusobacterium nucleatum subsp. vincentii ATCC 49256
MSILNRAIVIAGPTGVGKTKISIDLASELNAEIISSDSAQVYKGLNIGTAKITEKEMQGIKHHLIDIIEPISKYSVGNFEKDVNKILNQNPEKNFLLVGGTGLYINSVTKGLSILPEADKKTREYLSTLDNQTLFELALKYDKEATKEIHPNNRVRLERVVEVFLLTGQKFSELLKKNIKNNNFKFLKIALERDRENLYDRINKRVDIMFNQGLVDEVKNLYKIYGEKLYKLNIIGYNEIIDYINGVISLDEANYKIKLNSRHYAKRQFTWFKADKEYQWFNLDRISEQEIVKSIYKMFHIIKACI

SEQ ID NO: 349 - protein, 439 aa, Oryza sativa (japonica cultivar-group)
MAHLAASAAPLPSADPDAGEESSHSPPPPEKGLRKVVVVMGATGAGKSRLAVDLASHFAGVEVVSADSMQVYGGLDVLTNKVPLHEQKGVPHHLLSVIDPSVEFTCRDFRDHAVPALVSPFLFDDMAQDIEGLTLNDHLDEIGLDNDDEAGLYEHLKKIDPVAAQRIHPNNHRKIKRYLELYESTGALPSDLFQGQATEKWGRPSNSRFDCCFLWLDADLHVLDRYVNERVDCMIDDGLLDEVCNIYDREATYTQGLRQAIGVREFDEFFRFYFARKETGEIKMDSCTTMAGLHDDNLKGLLDEAVSQLKANTRRLVRRQRRRLHRLNKYFEWNLRHIDATEAFYGATADSWNMKVVKPCVDIVRDFLSDDTILASRDGSSVTGSPRMSSRELWTQYVCEACDNRVLRGTHEWEQHKQGRCHRKRVQRLKQKASTVISL

SEQ ID NO: 350 - protein, 427 aa, Oryza sativa (japonica cultivar-group)
MAATGRNAAARRTRRSIPRAAAVLPLSSGSPAAVLRRLGLGECFGWAGFMSSLGLKIRTVVRSPMAAAAVAGVGRDGSFASQKRPRRVSVRMERSRVGDGCCCSCSGRGGVASTTAVRPSTGMVVIVGATGTGKTKLSIDAAQELAGEVVNADKIQLYDGLDVTTNKVSLADRRGVPHHLLGAIRAEAGELPPSSFRSLAAAAAAGIASRGRVPVVAGGSNSLIHALLADPIDAAPRDPFADADVGYRPALRFPCCLLWVDVDDDVLDEYLDRRVDDMVGEGMVEELEEYFATTSASERASHAGLGKAIGVPELGDYFAGRKSLDAAIDEIKANTRVLAARQVGKIRRMADVWGWPIRRLDATATIRARLSGAGRAAEAAAWERDVRGPGLAAMRQFVGRADFNAAAVDQLAARSRRQCLRGGMVAG

SEQ ID NO: 351 - protein, 302 aa, Gloeobacter violaceus
MKKIVVVCGPTAAGKSQLGMHLAQHLGVPVLSADSRQVYREFDIGTAKPTREEQRRVEHCLIDVAWPTEHFNVARYRELADAEIDRLTRQGKPALLVGGSGLYLRAVSGGLEPPAVPPDPALRARLAVERLDALYQRLQQLDPESAGRIHPNDQVRIERALEVCLTTGQPLSAQRRLRARDFSLLALGVGSGREALVRRIEQRTHRMIEAGWLEEVEYLRAKYGPDLPLLSTLGYAELGAYLEERWDLAEALQQIVVHTRQFAKRQMTWFRAEPDVHWLDESAGRQTLEQQSIEQVERFLAG

SEQ ID NO: 352 - protein, 313 aa, Photorhabdus luminescens subsp. laumondii TTO1
MSDQKTQHLPTAIFVMGPTASGKTALSVALRQHLPVELISVDSALIYRGMDIGTAKPTTEEQALAPHRLINILDPSQPYSAADFCHDALKEMAEITASGRIPLLVGGTMLYFKALLEGLSPLPSANPVIRAQIEQQAAEQGWDALHQQLQKIDPAAALRIHPNDPQRLSRALEVFLISGKTLTELTTLSGESLPYRVHQFAIAPAKRELLHQRIEARFHQMLESGFEEEVKALYARHDLHVDLPSIRCVGYRQMWSYLSGEIDYDEMIYRGICATRQLAKRQITWLRGWKSVHWLDSSQPEQALSTVMQVVSA

SEQ ID NO: 353 - protein, 315 aa, Vibrio vulnificus YJ016
MTEQLPLALFLMGPTASGKTELAIRLRQRYPVELISVDSALIYKGMDIGTAKPDEREQQLAPHRLIDILDPTEAYSAADFRRDALAAMNEIVVQGKIPLLVGGTMLYFKALLEGLSPLPAANAEIRQQIEQEALTKGWSVLHDELQEIDPVSAARIHPNDPQRLSRALEVYRISGKTLTELTETKGESLPFRVKQFAIAPKERAELHRRIELRFDKMMEAGFEQEMRALYTRKDLHPDLPSIRCVGYRQMWDYLDGNCTLDEAIYRGICATRQLAKRQITWLRSWDNLTWLDSENIEQSLETLSEAIASDRDSCV

SEQ ID NO: 354 - protein, 488 aa, Magnaporthe grisea 70-15
MSCQQNYSSPEPLVVVMGSTGTGKSDLAVEIAHRFNGEIINADAMQMYEGLPIITNKITPEEQRGVPHHLLGMIGLEEPTWNVHHFRRKAGSIIREIRSRGHLPVLVGGTHYYLDGLLFDHNLVAAPPSEEGEKDHPAADAPATSASRDPALEEASTEELMARLREVDPVEADRRHPKDRRKIMRSLEIYLTTGRRASDIYAEQRETKAKMQQQRPSEGEQSTQQDHAPVFFWVHSERGVLNDRLERRVDKMLDNGLIEETRQMYTYLRRATMDGITIDRTTGIWQSIGFSEIEPYLDALHRQAEGESVDEQELEALKLAGVDLIKQATRRYAKGQVRWITHKTLPLIQDANMLPNLFLMDSSDVTRWSPEVVDKALNIMEKYLGGSALPEPAEVSEAAREVLGSVIASSNQKETPCNKTCEVCRITVLTEEKWLVHIRGHRHKRAVKSANKRAFVAAYLEGKGGGAAEKIQDEDADIPVAIRFEDNQ

SEQ ID NO: 355 - protein, 302 aa, Corynebacterium diphtheriae
MDNPTTPIAVVGPTASGKSALGVSLAHHLNGEVVNVDSMQLYKGMDIGTAKLTLEEREGIVHHLLDVWDISETASVARYQSQAIAVVEDIQRRGKTPILVGGSMLYVQSLVDDWQFPPTDPSVRAKWESKLNEVGVEALHALLAQKDPQAASIIELKDPRRTVRALEVIELTGKPFNASQPPKNAPPRWNTQIIGLGTNTEWLNPRIDLRTELMFEKGFVHEVENLVGKGLIADSTAGHAIGYAQVLQHFAGELSVDEMIEHTKIGTRRYVRRQRSWFKRDPRIHWIDASGDTFSMALSLLS

SEQ ID NO: 356 - protein, 321 aa, Rhodopseudomonas palustris
MATSDMTAEGPERHGRRPAAVLIAGPTASGKSALALKLAQASGGTVINTDSMQVYRDLRIITARPTPDEEALAPHRLYGTVDAAVNFSAGAYVEAAAAALAEVRAAGRLPILIGGTGLYFKALTRGLSAVPPVPAEVRDAVRLRLDRDGVQALHAELARQDPEAAARLAPADRTRIARALEVVLATGRPLADWHQQTSPPLLPPDDVVAVFLAPDREALYARIDSRFAAMLQGGALDEVAALAERQLDPLLPAMKAHGVPALIRHLRGEITLEEAASIGAADTRHYAKRQFTWFRHQLPEFKWVRPEEADAFLNTVIPGRA

SEQ ID NO: 357 - protein, 291 aa, Onion yellows phytoplasma
MKKVIAITGPTASGKTSLSIKIAKKFNLEIINCDSLQMYQKYDIGTAKITLEEAQGIKHHLLDFLAPGTNYSIYHFQKDARKKIEETPLPLFVGGSGLYLKSALFDYELTPKSLFLPPTSLPAIENMIDFIKQKDPQLIANLDLKNPRRILSAYQDLLEGTLRSQKNKKHNSLYSSLIFYLDIDRQILKKRVILRLEQMLKQGFIEEVNQIQTHFPNPNFNIIGYREIKALLEGKITLDQAKTLIIQKTMQYAKRQKTWFKNQIKPIILDALSPDLEKTTICLINDFLKTD

SEQ ID NO: 358 - protein, 311 aa, Geobacter sulfurreducens PCA
MGNQAGSKTKLVIIQGPTASGKSELAVRLAEACGGDVVNADSMQVYRGMDIGTAKPSPELVARVPHHLYDIVDPDVNFTAADYRREAGRVITEIHSRGKRPILVGGTGLYIKTLIGGLAPSPGADDTIRAELEEDARSEGAAALHDRLAQVDPAAAARLHPNDRVRIVRALEVFLMTGKPLSEFQEEHRFADEPYDCLKLGISVERDDLYRRINERVNRMFAEGFVEEVSGLLNAGYSPDLKAMGAIGYKEVCAYLAGTCSLDEARELVQRNTRRYAKRQLTWFRKDPAIKWVEYPANFDSISTIAMKFFG

SEQ ID NO: 359 - protein, 312 aa, Zymomonas mobilis
MSISESPKKHPVLLIAGPTASGKSQLAIAMGIKTNGIIINADASQLYTDLQILTARPSDADEKILPHRLFGIQDGSEPASAVFWAELAKKEIKNAHESGRLPILVGGTGLYIRTLLEGIAPIPDIAPELREEVRSMSVEEAYSALQQEDPMAADRLRPTDKTRIMRALEVMRSTGHPLHYWQQKKTGGIANEIKLQSFVIIPPANILRSRCDKRFDQMLEQGAEKEVIRLMGRQLPADLPIMRAIGVREIASYIRREIDRLTMIEKAKAATRQYAKRQRTWFRHQTDESWIIFFDDINFNPIDDFAIKLLSI

SEQ ID NO: 360 - DNA, 2341 bp, Zea mays
gacaagtgcaggcatattctcacacattcacttcgctgaaacttaaaacacacatgttctcacattaaactgaaaacacacatttgctactacacataggctattgtgcgagaacacacatttgctactacacaatcacttgatgaccccaatcaatttcagggacctgcaaaacaattattttatgttatgtaaaccattgctctgtgtatgctaaaccctgaatacatgaaagaactataataacagaaccctaaaccgataggtacaaatgtgctacaaattaaacaactaatggtatggatctaacctcagttccattaatagttgtaggatctgaaaatcccaaattcagacttgaagtagaggaatccaaaacagcaacaacatccattgcttcacaatgtgcaccagcaagaacatcagtgccaatcccatccaatcctcgtcagttctaaaattgtcttaaacatcacttcgccacccaatcctcgtcagtccttgccaccaataacattttcttataacagtataacacacattttgtatataagttatcatggtattatatgtccccgttgcaacgcacgggcactcacctagtatacaatatatatatatatatatatatatatatatatatatatatatatatatatatatatgtgtgtgtgtgtgtgtgtgtgtgtgattttcagatttaggattatattattgtcccttagaccattttagtgagagttttatcatagtttcatttttattaacttagataacatatcaccatatttatgatataacacgatatttatgatgagagagatagagttttatgatagaagagaaggttttatctaaatgaaacttaagatacacgattttatagataaaatttggtgtgtcacttttgaaaactgtgcaataaaactttcaatggaaatgaccttagctgtcttttgtcagcagaaaactgattaaagtgctcaatgttgtacaagccctagttggagcctaaggctgtcaacagccacgtacgccaggccgccccctccccttgatctggcggctacaggagccctccacggctgcaacgacgtcctctacaagaccctctagccagcagatgtgaataggaaacggccacagccagcgtgaggccgccatccctttattcactgttcattcgtacggtgcttttttaataagtgaagaaaaaatgataatagatgatgaatatggttagataatgatattttatagttatagtgggtatagggagaaaatatagagggaaccggtgtggaagataaaaaataagataaaatgtttatgatgtgacttaaaaaaatgatatatgggaaaaatttagagagaactaggacaacaactaagtgctagtttgtccatgtgtttggagcagtagaccaagtaggctaggcacgaaaagaccttactcaccggtcattcaagagacggatggagaggcactagtgtgcagagtgcagtgcagctgctgcgtgtcgctgctcctgtctggggaacccaaaaagatgttggagggaagcccaaaaaatcaaagccctggacggccctcctcaccacgccgctcgccgcagcactaaagaagccgctgttttgcatgcgtgtcactctctctctctcgctcctccctctccctccccgttctctttctatctcctgttctcctctcaaacctcaataaaaccacgctttccctcctctccacttcggattctgctctgccttcgcctcgtcactacccacgccactgcatagaccgagaaaaaggacgaattttttcctcgccgcaacctcacaccatggaagaggcgatgccgccgccgccgccgccgctctcatcttcctcctccgccgccgtggcctgagctctcccatcgctcgctctctccatcgggcctacctatcctagcagtgaataagtcatggcagctttcgccgcgttgttcgaccccctctactgcccggaggagcacctcgatctgtaccacgaaggacccgtcgaggttgtggacgagcagtggcaggaccagcgcggacagcagcaaccggcggctcttgacgacgagctgccggcgctgttcgaggcgctccgggacaaggagggggtggtgctggcgggtgatggggaggaggatgggtacggcggctcggcaggccgggaggccgcagtcggctgggcgtcacgcgccgcggcacggctgggcttctctgcgctcacttccgcgctgtccgccgcctacctggaccgctgcttcctccccgggggcgcgctccgtctcggcgaccagccctggatgtc

SEQ ID NO: 361 - DNA, 1658 bp, Oryza sativa
atttacagtgttcacggtgtgacagcaggagtatacatgtaggctgtgaattgtgtactgtgtcagtttgtgttttcgagagtagaggttgtacactaggctttcctctttcagcatacattctcaaggcaattctttttatttgcctgccagcagctgtttgtggtgttcgtcaaacatgctgtgcaaaatgatgattattcttgagcattatatctattaacgttcgaaaagtgatagtttgcttagaaggagcttcccttgaataatcaagaaatgtacatataatcacttccatctatggtgcgtaactggtcgcacgaagtcagtggtgattgtgttgtattcaaaggatcaactattgtgttatctggcaagtgattttaatagggcgttttgccacagtaattcttctaatggagtcatttgtttgcctcatggagaattcacccctactgaaaaccttgtcctgttgaactaatgctgtatatgaggcattctgataaacccctgtaaaatcgtcctaatttccagtttgaccgttttattctgttcacccacattttcagtagtactacggcataggagtatgcactaatgtactccgtatcctccccgagacgtctgtccactgtcatagtcacatgcaagtcaattcaagtcttgagatacactaatcttcaatccaaagctagctgtactggccttttgtcagtgcacaatttggaccacatggaccacatattcacatgcctctctcaagctctcagcaaaattctcagcagtgtacagtatactcttgtatgcggtgtacttcctcgtgggtgtaaataaggcttttgcttaattccatcagaaattgctgctccactcttctcgctcaaagtgttctctcttttattttggagatgcttttcttgcccaaagttgagctcaagctcactttcatctcctgggaagtttgcacagtgccctgtatgacacatgctcgctcaaatcaacctttttctcttatgatttttcatcgtcagtaaattccaagcaggtctgtatatgttaataaaaagaaaactcgaatgaaaatgaaacttccagcctactacgtacgagtacatagtattgtgttgttaatggcaactccactaaaatggaaggcttttccagctcgatggctcaatccatacccatacctacacccaacggctagtttcgcgtggcagccgcggccaatcatagccgtccgatgctccgcttcctgaccgttgcgattcgaagccctcccgaccgttggagcggccgctccccctccgctccacgtaaaaaaggcaacgccacccgacacagaggacgcgccctgccctagctcgctatatctcgcccctcctccacgcgccgcctccaagaactgtataccaccacgcatcaatcacacgccgcacgccgacgccgattggttgatttgattgattgattgggcaagaggaggaggaggaaggggattgtttgctgctgctgctgctccagagctcgccggagccgcggtggctgcagcgctcgacggcggggaagaggggtcgcgggcggcgcggctgcactcgttcttcgcctcggtgatctccgggatcttcggccagggcgaggaggaggaggaaggggag

SEQ ID NO: 362 - DNA, 1092 bp, Oryza sativa
gagtcccacagcggaggacagctagcaagacggaggctagtaaagggcggagagtagcgagcagggtggaggtcggcaaccacccccatcttctctggatctgggcataggtgatggcggagaaggagtgacgatatggccatggcatcaagcggtccctcaatgtggggccagacgccatcgatcaatggcaagcttgaaggaggtcaggatggagttgcaagtcttaggtgcgatttgttgattgctctgttgggttaccatcgatttctctgttgattttattgggggtcgattggagttctccctatactgattttacttggacggatttgaattcgatttgacaaatcgaagtttatcccccatttcagtttcgtgttcgagttggcagtttagaatcaggagatggttcggtggaattttttttaggaggtttggttagattagattgccaacataagaaagccgtggtgagttgtgaccttcaaaaatcaaaataaaccaccagtacagccaccatatggcccacacgtcagccacgtacaaaaaaacaaccagcgcaataataacgaaacatgaaattttcctcggtgcccctatcgaatttaccacaccacactttccatctctggggcatcccactcccaacgtattttcacacgcaactattttattttaccgttgcaagtctcatcccctctatttaaacggctcaaaaaacccggagcggtgaatctccaccgtccgatcagtgatccgaccgccgatgcgccgttggttccccattaataaaaatttgaccgttggaaagatagacgccacggcaaaattcctcaattccccaccaaaaaaaaccaacccatcgcctacaaagccatagccctccctcttcttctccttcgaaaccaatccatctcgagttctcgccgtcaagaatcggaggagcagaggagagggaggagaattcgagagagaggagaggaggaggaggaggaggaggaggcggagtgaggtgtaagggggtggtggtgacgcgtcgctgattcgtgcggtttgctctgtggacgccgatcccggccgtttcgggcg

SEQ ID NO: 363 - DNA, 935 bp, Zea mays
agttcttgtccatgtcaacatcatgttatcatgaggcaaagacatgacgccacacacaacaccgagccaaaagtcctaaaataaaaaaaaattaaaacatagtctcaatgtaagtattcttaaaaaaacaggcgaacaaataaaaaaaatcagtgcctgtgagacgttgatgtgaaagctttgttaaaaacacacgcgaaacccccaatcatttaatactgcgtccgcacatgttaaatacgttaatttgttaacaaaactaacctctatgatgtttttcatgtatcagtttctaacacgagtatcttgaaaataatacggaagagttttatttccttaaaacctctttacttttatgatttttatcgtatatttttcattaatacagtgataaagctcatgaaccgtgttgaaaccgaccaaacgacacgcgccgtaaaagaaagcgttagtccctttccagctcgtaggcgaatcccactcgccgtcgccgcaacggctagtgttgaaaccggctcctcccgactgttgcgatacgaactctttctgagtcccgaccgttggaaccgctcctctcgcctcctcgacccactccgccttgcctggcagcagcagcgctcgcccgcgcgctcgtttatattatatctgtgcgactgtgcctcccctccccgagccatagcctcctcgtcccctcgagaactgtaccatcacgcgccgcctttgattgagcagggactgggagagaggagaagagagggtgaaagggggcaagaaaacgcttcttgttgcctttgtgcttcagcggatccgcggtggctgcgcacgccggcggggaagaggagtcgcgggcggcgcgcctccagtcttttttcgcctccgtgctctccgggctcttcggccaggccgaggccgaggacgaggacgaggacgaagag

SEQ ID NO: 364 - DNA, 2000 bp, Oryza sativa
agcggtttagaaaaggtgcgtgcaaaaacgaactcagcgtaaagatggttaattagcaattcattaaagcagtagtcctagtttaaaaaataaataacggtaacaaaacaacaattatagacaaaattcaagcacaaataaaaacaattaggacaaagcctatgcctatcagagcaaggataataatatagcccacttcctactaagtattagcctatactaaagttaacacatataatagattagctataaggttagctataattttcttcttcttctatctctatctctcacttagagcagatacaatagcaggttattagtcagctataaacatattttaatgagataaacgatgagagagaagaccagcgagctacagatttgtagccagctgcagcacggactccaagacgtaatgtgcgtatgacaggtgtgaccgtatattaatagtatagtaagcaactattgtatgaattggctattagattggctatagatgaattggagctaatagtgggctatactattgaacttgctcttatacatttaatgtatttgtcttagagcttgtgttaagctagctcttgcataagagccaacactattctcttttgtttacctctctcctccacataagattatagtaggcttatagctcactattatacttgctctcagtagtaggcatccatccatccatccttatcaaaatacagcgggtacgagctttggaaaagtttaaggttatgagaaataattggtttttttaattgaaaatttgagatttaaacaagtgtccataaaatccggtacatttgcagttaatactatttgtgaaagttgtatatttttatcatttgaaaatttgaatgcagggaaaaatactacccgttgggacaaaatacgtactggtactagtatgcatctgtatacagtactcctagcgatggatttgcgttgcgaggtgggcaagcaggcaagagggaagaggatggaaaagacagcactgcacagccacaacagcgttgcagccacagcgttgcagcctgctgccctgccttgcctggggaaccccgaaagcaacccaacccagggtagggagggaagccgaaaaatcaaaagcaaaccaacgcaacgcaataaaagctcctctctctctctcgctctccaaccccaactctaataaataaaaacctctcatccatcgcctcgtcttcttcgtctctctccctccacgctccaccacgaccaaaagccatgcctatgctgctgctgccgctctcctcctcttccgccattgccgccacctgagctgagctcttgtactcgctacgctactcaagatggctttcgccacgctctttgactccctctactgccccgaggagcacctcgacctcttccatgacaccgccgccgacgacgacctccacctcgaccttcacctgcaccaacccccaccgccgccgccgctcctcgacgacgaccttcctgcgctgttccacgcgctcagggtgaaggaggacccgctgcgccccgccgccgacgacgacggctacggcggggtgtctgcccgggaggcggcggtcgggtgggcgctgcgcgccgtcgcgaggctcggcttctccgcgctcacggccgcgctcgccgtcgcctacctcgaccgctgcttcctcggcggcgcgctccgcctcggcgaccgcccctggatggcgcgcctcgccgccgtcgcctgcgtcgcgctcgccgccaaggtggaggagacgcgcgtgcccgtgctcctcgacctccagctctgcgccgccgaacgcgccgaccccaacgaggcctacgtgttcgaggacaagacggtgcgccgcatggagctgctggtgctctcggcgctcggatggcggatgcaccccgtgacgcccctctcctacctccaacccctcctcggcaccgcccacgccgcgcgccttcaccactgcgacaccgcattgctcgcgctgatgccc

The invention claimed is:

1. A recombinant DNA polynucleotide comprising a cell cycle regulated promoter that expresses an operably linked polynucleotide at its highest levels in actively dividing cells as compared to non-dividing cells operably linked to a DNA polynucleotide encoding an isopentenyl transferase.

2. A recombinant DNA polynucleotide of claim 1 wherein said cell cycle regulated promoter is a cyclin promoter selected from the group consisting of the CycD3 cyclin promoter having the sequence of SEQ ID NO:8 and the CycB1 cyclin promoter having the sequence of SEQ ID NO:5.

3. A plant cell comprising a recombinant DNA polynucleotide of claim 1, wherein said recombinant DNA polynucleotide is stably inserted into the genome of a plant cell.

4. A transgenic plant comprising a recombinant DNA polynucleotide of claim 1.

5. A seed of the transgenic plant of claim 4, wherein the seed comprises the recombinant DNA polynucleotide of claim 1.

6. A transgenic plant comprising a recombinant DNA polynucleotide of claim 1 and exhibiting at least one phenotypic trait not exhibited by a plant not containing a recombinant DNA polynucleotide of claim 1, said phenotypic trait being selected from the group consisting of accelerated plant growth, increased organ size, increased organ number, increased reproductive organ number, increased seed size, increased silique number, and increased seed number.

* * * * *